US006759508B2

(12) United States Patent
Lodes et al.

(10) Patent No.: US 6,759,508 B2
(45) Date of Patent: Jul. 6, 2004

(54) COMPOSITIONS AND METHODS FOR THE THERAPY AND DIAGNOSIS OF LUNG CANCER

(75) Inventors: Michael J. Lodes, Seattle, WA (US); Raodoh Mohamath, Seattle, WA (US); Robert A. Henderson, Edmonds, WA (US); Darin R. Benson, Seattle, WA (US); Heather Secrist, Seattle, WA (US)

(73) Assignee: Corixa Corporation, Seattle, WA (US)

(*) Notice: Subject to any disclaimer, the term of this patent is extended or adjusted under 35 U.S.C. 154(b) by 7 days.

(21) Appl. No.: 09/854,133

(22) Filed: May 11, 2001

(65) Prior Publication Data

US 2002/0183499 A1 Dec. 5, 2002

Related U.S. Application Data

(63) Continuation-in-part of application No. 09/738,973, filed on Dec. 14, 2000, which is a continuation-in-part of application No. 09/704,512, filed on Nov. 1, 2000, now abandoned, which is a continuation-in-part of application No. 09/667,170, filed on Sep. 20, 2000.
(60) Provisional application No. 60/229,763, filed on Sep. 1, 2000.

(51) Int. Cl.[7] .............................................. C07K 14/435

(52) U.S. Cl. ........................ 530/324; 530/350; 530/326

(58) Field of Search ................................ 530/350, 326, 530/327, 328, 324, 325; 514/12, 13, 14, 15

(56) References Cited

U.S. PATENT DOCUMENTS

| 5,589,579 | A | 12/1996 | Torczynski et al. ......... 536/23.1 |
|---|---|---|---|
| 5,849,578 | A | 12/1998 | Falb ............................. 435/325 |
| 5,882,925 | A | 3/1999 | Falb ............................. 435/325 |
| 6,018,025 | A | 1/2000 | Falb et al. ................... 530/350 |
| 6,020,463 | A | 2/2000 | Falb et al. ................... 530/350 |
| 6,124,433 | A | 9/2000 | Falb et al. ................... 530/350 |

FOREIGN PATENT DOCUMENTS

| EP | 1 033 401 | 9/2000 |
|---|---|---|
| WO | WO 96/02552 | 2/1996 |
| WO | WO 96/24604 | 8/1996 |
| WO | WO 99/38972 | 8/1999 |
| WO | WO 99/38973 | 8/1999 |
| WO | WO 99/58675 | 11/1999 |
| WO | WO 00/60077 | 10/2000 |
| WO | WO 01/02568 | 1/2001 |
| WO | WO 01/54477 | 8/2001 |
| WO | WO 01/57188 | 8/2001 |
| WO | WO 01/79292 | 10/2001 |
| WO | WO 01/83553 | 11/2001 |
| WO | WO 01/96390 | 12/2001 |

OTHER PUBLICATIONS

Swiss Prot Accession No. AB026891, Aug. 2, 1999.
EMBL Accession No. ABA09201, Aug. 9, 2001.
Chen et al., "Isolation and characterization of a novel gene expressed in multiple cancers," *Oncogene*, 12:741–751, Feb. 15, 1996.
Clay et al., "Efficient transfer of a tumor antigen–reactive TCR to human peripheral blood lymphocytes confers anti–tumor reactivity," *The Journal of Immunology 163*:507–513, 1999.
Fenwick et al., "A subclass of Ras proteins that regulate the degradation of IkB," *Science*, 287:869–873, Feb. 4, 2000.
Gure et al., "Human lung cancer antigens recognized by autologous antibodies: definition of a novel cDNA derived from the tumor suppressor gene locus on chromosome 3p21.3," *Cancer Research*, 58:1034–1041, Mar. 1, 1998.
Heller et al., "Discovery and analysis of inflammatory disease–related genes using cDNA microarrays," *Proc. Natl. Acad. Sci. USA 94*:2150–2155, Mar. 1997.
Okamoto et al., "Overexpression of human mutT homologue gene messenger RNA in renal–cell carcinoma: evidence of persistent oxidative stress in cancer," *International Journal of Cancer* 65(4):437–441, Feb. 8, 1996.
Porter et al., "Mechanistic studies of the inhibition of MutT dGTPase by the carcinogenic metal Ni(II)," *Chem. Res. Toxicol.* 9(8):1375–1381, Dec. 1996.
Schena et al., "Parallel human genome analysis: microarray–based expression monitoring of 1000 genes," *Proc. Natl. Acad. Sci. USA 93*:10614–10619, Oct. 1996.
Wu et al., "Polymorphisms and probable lack of mutation in a human mutT homolog, hMTH1, in hereditary nonpoliposis colorectal cancer," *Biochemical and Biophysical Research Communications* 214(3): 1239–1245, Sep. 25, 1995.
Schena et al., "Quantitative monitoring of gene expression patterns with a comiplementary DNA microarray," *Science* 270:467–470, Oct. 20, 1995.
GenBank Database, Accession No. AAG35592, Dec. 1, 2000.
GenBank Database, Accession No. AAH12087, Aug. 6, 2001.
GenBank Database, Accession No. AAK49111, May 2, 2001.
GenBank Database, Accession No. AB026891, Feb. 10, 2001.

(List continued on next page.)

*Primary Examiner*—James Martinell
(74) *Attorney, Agent, or Firm*—Seed Intellectual Property Law Group PLLC

(57) ABSTRACT

Compositions and methods for the therapy and diagnosis of cancer, particularly lung cancer, are disclosed. Illustrative compositions comprise one or more lung tumor polypeptides, immunogenic portions thereof, polynucleotides that encode such polypeptides, antigen presenting cell that expresses such polypeptides, and T cells that are specific for cells expressing such polypeptides. The disclosed compositions are useful, for example, in the diagnosis, prevention and/or treatment of diseases, particularly lung cancer.

8 Claims, No Drawings

OTHER PUBLICATIONS

GenBank Database, Accession No. AB040875, Apr. 3, 2001.
GenBank Database, Accession No. AB042201, Feb. 10, 2001.
GenBank Database, Accession No. AC093903, Mar. 1, 2002.
GenBank Database, Accession No. AF200708, Dec. 1, 2000.
GenBank Database, Accession No. AF252872, May 2, 2001.
GenBank Database, Accession No. AJ277882, Jan. 4, 2002.
GenBank Database, Accession No. BAA82628, Feb. 10, 2001.
GenBank Database, Accession No. BAA94999, Feb. 10, 2001.
GenBank Database, Accession No. BAB40574, Apr. 3, 2001.
GenBank Database, Accession No. BC012087, Aug. 6, 2001.
GenBank Database, Accession No. CAC81905, Jan. 4, 2002.
GenBank Database, Accession No. NM_014331, Apr. 6, 1999.
GenBank Database, Accession No. NP_055146, Apr. 6, 1999.
GenBank Database, Accession No. XM_105956, May 8, 2002.
GenBank Database, Accession No. XP_105956, May 8, 2002.
Geneseq Database (Derwent), Accession No. AAA00880, May 19, 2000.
Geneseq Database (Derwent), Accession No. AAF65392, Apr. 9, 2001.
Geneseq Database (Derwent), Accession No. AAM23914, Oct. 12, 2001.
Geneseq Database (Derwent), Accession No. AAH98573, Oct. 12, 2001.
Geneseq Database (Derwent), Accession No. AAZ12811, Oct. 12, 1999.
Geneseq Database (Derwent), Accession No. AAZ13772, Oct. 12, 1999.
Geneseq Database (Derwent), Accession No. AAZ14304, Oct. 12, 1999.
Geneseq Database (Derwent), Accession No. AAZ14962, Oct. 12, 1999.
Geneseq Database (Derwent), Accession No. AAZ14980, Oct. 12, 1999.
Geneseq Database (Derwent), Accession No. AAZ15945, Oct. 12, 1999.
Geneseq Database (Derwent), Accession No. AAZ16207, Oct. 12, 1999.
Geneseq Database (Derwent), Accession No. AAZ16401, Oct. 12, 1999.
Geneseq Database (Derwent), Accession No. AAZ16528, Oct. 12, 1999.
Geneseq Database (Derwent), Accession No. AAZ16609, Oct. 12, 1999.
Geneseq Database (Derwent), Accession No. AAZ17094, Oct. 12, 1999.
Geneseq Database (Derwent), Accession No. AAZ17469, Oct. 12, 1999.
Hillier, L. et al., "Generation and Analysis of 280,000 Human Expressed Sequence Tags," *Genome Research* 6:807–828, 1996.
Wallace and Miyada, "Oligonucleotide Probes for the Screening of Recombinant DNA Libraries," *Methods in Enzymology 152*: 432–442, 1987.
GenBank Accession No. AL157971, Feb. 25, 2000.
GenBank Accession No. N54011, Feb. 18, 1996.
El–Deiry W., "Role of oncogenes in resistance and killing by cancer therapeutic agents," *Current Opinion in Oncology* 9(1):79–87, Jan. 1997.

COMPOSITIONS AND METHODS FOR THE THERAPY AND DIAGNOSIS OF LUNG CANCER

CROSS REFERENCE TO RELATED APPLICATIONS

This application is a continuation in part of U.S. patent application Ser. No. 09/738,973, filed Dec. 14, 2000; U.S. patent application Ser. No. 09/704,512, filed Nov. 1, 2000 now abandoned; and U.S. patent application Ser. No. 09/667,170, filed Sep. 20, 2000; each a CIP of the previous application and all pending; and U.S. Provisional Application No. 60/229,763, filed Sep. 1, 2000, each incorporated herein by reference.

TECHNICAL FIELD OF THE INVENTION

The present invention relates generally to therapy and diagnosis of cancer, such as lung cancer. The invention is more specifically related to polypeptides, comprising at least a portion of a lung tumor protein, and to polynucleotides encoding such polypeptides. Such polypeptides and polynucleotides are useful in pharmaceutical compositions, e.g., vaccines, and other compositions for the diagnosis and treatment of lung cancer.

BACKGROUND OF THE INVENTION

Lung cancer is the primary cause of cancer death among both men and women in the U.S., with an estimated 172,000 new cases being reported in 1994. The five-year survival rate among all lung cancer patients, regardless of the stage of disease at diagnosis, is only 13%. This contrasts with a five-year survival rate of 46% among cases detected while the disease is still localized. However, only 16% of lung cancers are discovered before the disease has spread.

Early detection is difficult since clinical symptoms are often not seen until the disease has reached an advanced stage. Currently, diagnosis is aided by the use of chest x-rays, analysis of the type of cells contained in sputum and fiberoptic examination of the bronchial passages. Treatment regimens are determined by the type and stage of the cancer, and include surgery, radiation therapy and/or chemotherapy. In spite of considerable research into therapies for the disease, lung cancer remains difficult to treat.

Accordingly, there remains a need in the art for improved vaccines, treatment methods and diagnostic techniques for lung cancer.

SUMMARY OF THE INVENTION

In one aspect, the present invention provides polynucleotide compositions comprising a sequence selected from the group consisting of:

(a) sequences provided in SEQ ID NO: 217–390, 392, 394, 396, 398–420 422–424, 428–433, 440–583 and 588–732;

(b) complements of the sequences provided in SEQ ID NO: 217–390, 392, 394, 396, 398–420 422–424, 428–433, 440–583 and 588–732;

(c) sequences consisting of at least 20 contiguous residues of a sequence provided in SEQ ID NO: 217–390, 392, 394, 396, 398–420 422–424, 428–433, 440–583 and 588–732;

(d) sequences that hybridize to a sequence provided in SEQ ID NO: 217–390, 392, 394, 396, 398–420 422–424, 428–433, 440–583 and 588–732, under moderately stringent conditions;

(e) sequences having at least 75% identity to a sequence of SEQ ID NO: 217–390, 392, 394, 396, 398–420 422–424, 428–433, 440–583 and 588–732;

(f) sequences having at least 90% identity to a sequence of SEQ ID NO: 217–390, 392, 394, 396, 398–420 422–424, 428–433, 440–583 and 588–732; and (g) degenerate variants of a sequence provided in SEQ ID NO: 217–390, 392, 394, 396, 398–420 422–424, 428–433, 440–583 and 588–732.

In one preferred embodiment, the polynucleotide compositions of the invention are expressed in at least about 20%, more preferably in at least about 30%, and most preferably in at least about 50% of lung tumors samples tested, at a level that is at least about 2-fold, preferably at least about 5-fold, and most preferably at least about 10-fold higher than that for normal tissues.

The present invention, in another aspect, provides polypeptide compositions comprising an amino acid sequence that is encoded by a polynucleotide sequence described above.

In specific embodiments, the present invention provides polypeptide compositions comprising an amino acid sequence selected from the group consisting of sequences recited in SEQ ID NO: 391, 393, 395, 397, 421, 425–427, 434–439 and584–587.

In certain preferred embodiments, the polypeptides and/or polynucleotides of the present invention are immunogenic, i.e., they are capable of eliciting an immune response, particularly a humoral and/or cellular immune response, as further described herein.

The present invention further provides fragments, variants and/or derivatives of the disclosed polypeptide and/or polynucleotide sequences, wherein the fragments, variants and/ or derivatives preferably have a level of immunogenic activity of at least about 50%, preferably at least about 70% and more preferably at least about 90% of the level of immunogenic activity of a polypeptide sequence set forth in SEQ ID NOs:391, 393, 395, 397, 421, 425–427, 434–439, 584–587 and or a polypeptide sequence encoded by a polynucleotide sequence set forth in SEQ ID NOs: 217–390, 392, 394, 396, 398–420 422–424, 428–433 440–583 and 588–732.

The present invention further provides polynucleotides that encode a polypeptide described above, expression vectors comprising such polynucleotides and host cells transformed or transfected with such expression vectors.

Within other aspects, the present invention provides pharmaceutical compositions comprising a polypeptide or polynucleotide as described above and a physiologically acceptable carrier.

Within a related aspect of the present invention, the pharmaceutical compositions, e.g., vaccine compositions, are provided for prophylactic or therapeutic applications. Such compositions generally comprise an immunogenic polypeptide or polynucleotide of the invention and an immunostimulant, such as an adjuvant.

The present invention further provides pharmaceutical compositions that comprise: (a) an antibody or antigen-binding fragment thereof that specifically binds to a polypeptide of the present invention, or a fragment thereof, and (b) a physiologically acceptable carrier.

Within further aspects, the present invention provides pharmaceutical compositions comprising: (a) an antigen presenting cell that expresses a polypeptide as described above and (b) a pharmaceutically acceptable carrier or excipient. Illustrative antigen presenting cells include dendritic cells, macrophages, monocytes, fibroblasts and B cells.

Within related aspects, pharmaceutical compositions are provided that comprise: (a) an antigen presenting cell that expresses a polypeptide as described above and (b) an immunostimulant.

The present invention further provides, in other aspects, fusion proteins that comprise at least one polypeptide as described above, as well as polynucleotides encoding such fusion proteins, typically in the form of pharmaceutical compositions, e.g., vaccine compositions, comprising a physiologically acceptable carrier and/or an immunostimulant. The fusions proteins may comprise multiple immunogenic polypeptides or portions/variants thereof, as described herein, and may further comprise one or more polypeptide segments for facilitating the expression, purification and/or immunogenicity of the polypeptide(s).

Within further aspects, the present invention provides methods for stimulating an immune response in a patient, preferably a T cell response in a human patient, comprising administering a pharmaceutical composition described herein. The patient may be afflicted with lung cancer, in which case the methods provide treatment for the disease, or patient considered at risk for such a disease may be treated prophylactically.

Within further aspects, the present invention provides methods for inhibiting the development of a cancer in a patient, comprising administering to a patient a pharmaceutical composition as recited above. The patient may be afflicted with lung cancer, in which case the methods provide treatment for the disease, or patient considered at risk for such a disease may be treated prophylactically.

The present invention further provides, within other aspects, methods for removing tumor cells from a biological sample, comprising contacting a biological sample with T cells that specifically react with a polypeptide of the present invention, wherein the step of contacting is performed under conditions and for a time sufficient to permit the removal of cells expressing the protein from the sample.

Within related aspects, methods are provided for inhibiting the development of a cancer in a patient, comprising administering to a patient a biological sample treated as described above.

Methods are further provided, within other aspects, for stimulating and/or expanding T cells specific for a polypeptide of the present invention, comprising contacting T cells with one or more of: (i) a polypeptide as described above; (ii) a polynucleotide encoding such a polypeptide; and/or (iii) an antigen presenting cell that expresses such a polypeptide; under conditions and for a time sufficient to permit the stimulation and/or expansion of T cells. Isolated T cell populations comprising T cells prepared as described above are also provided.

Within further aspects, the present invention provides methods for inhibiting the development of a cancer in a patient, comprising administering to a patient an effective amount of a T cell population as described above.

The present invention further provides methods for inhibiting the development of a cancer in a patient, comprising the steps of: (a) incubating $CD4^+$ and/or $CD8^+$ T cells isolated from a patient with one or more of: (i) a polypeptide comprising at least an immunogenic portion of polypeptide disclosed herein; (ii) a polynucleotide encoding such a polypeptide; and (iii) an antigen-presenting cell that expressed such a polypeptide; and (b) administering to the patient an effective amount of the proliferated T cells, and thereby inhibiting the development of a cancer in the patient. Proliferated cells may, but need not, be cloned prior to administration to the patient.

Within further aspects, the present invention provides methods for determining the presence or absence of a cancer, preferably a lung cancer, in a patient comprising: (a) contacting a biological sample obtained from a patient with a binding agent that binds to a polypeptide as recited above; (b) detecting in the sample an amount of polypeptide that binds to the binding agent; and (c) comparing the amount of polypeptide with a predetermined cut-off value, and therefrom determining the presence or absence of a cancer in the patient. Within preferred embodiments, the binding agent is an antibody, more preferably a monoclonal antibody.

The present invention also provides, within other aspects, methods for monitoring the progression of a cancer in a patient. Such methods comprise the steps of: (a) contacting a biological sample obtained from a patient at a first point in time with a binding agent that binds to a polypeptide as recited above; (b) detecting in the sample an amount of polypeptide that binds to the binding agent; (c) repeating steps (a) and (b) using a biological sample obtained from the patient at a subsequent point in time; and (d) comparing the amount of polypeptide detected in step (c) with the amount detected in step (b) and therefrom monitoring the progression of the cancer in the patient.

The present invention further provides, within other aspects, methods for determining the presence or absence of a cancer in a patient, comprising the steps of: (a) contacting a biological sample obtained from a patient with an oligonucleotide that hybridizes to a polynucleotide that encodes a polypeptide of the present invention; (b) detecting in the sample a level of a polynucleotide, preferably mRNA, that hybridizes to the oligonucleotide; and (c) comparing the level of polynucleotide that hybridizes to the oligonucleotide with a predetermined cut-off value, and therefrom determining the presence or absence of a cancer in the patient. Within certain embodiments, the amount of mRNA is detected via polymerase chain reaction using, for example, at least one oligonucleotide primer that hybridizes to a polynucleotide encoding a polypeptide as recited above, or a complement of such a polynucleotide. Within other embodiments, the amount of mRNA is detected using a hybridization technique, employing an oligonucleotide probe that hybridizes to a polynucleotide that encodes a polypeptide as recited above, or a complement of such a polynucleotide.

In related aspects, methods are provided for monitoring the progression of a cancer in a patient, comprising the steps of: (a) contacting a biological sample obtained from a patient with an oligonucleotide that hybridizes to a polynucleotide that encodes a polypeptide of the present invention; (b) detecting in the sample an amount of a polynucleotide that hybridizes to the oligonucleotide; (c) repeating steps (a) and (b) using a biological sample obtained from the patient at a subsequent point in time; and (d) comparing the amount of polynucleotide detected in step (c) with the amount detected in step (b) and therefrom monitoring the progression of the cancer in the patient.

Within further aspects, the present invention provides antibodies, such as monoclonal antibodies, that bind to a polypeptide as described above, as well as diagnostic kits comprising such antibodies. Diagnostic kits comprising one or more oligonucleotide probes or primers as described above are also provided.

These and other aspects of the present invention will become apparent upon reference to the following detailed description. All references disclosed herein are hereby incorporated by reference in their entirety as if each was incorporated individually.

SEQUENCE IDENTIFIERS

SEQ ID NO: 1 is the determined cDNA sequence for L363C1.cons

SEQ ID NO: 2 is the determined cDNA sequence for L263C2.cons

SEQ ID NO: 3 is the determined cDNA sequence for L263C2c

SEQ ID NO: 4 is the determined cDNA sequence for L263C1.cons

SEQ ID NO: 5 is the determined cDNA sequence for L263C1b

SEQ ID NO: 6 is the determined cDNA sequence for L164C2.cons

SEQ ID NO: 7 is the determined cDNA sequence for L164C1.cons

SEQ ID NO: 8 is the determined cDNA sequence for L366C1a

SEQ ID NO: 9 is the determined cDNA sequence for L260C1.cons

SEQ ID NO: 10 is the determined cDNA sequence for L163C1c

SEQ ID NO: 11 is the determined cDNA sequence for L163C1b

SEQ ID NO: 12 is the determined cDNA sequence for L255C1.cons

SEQ ID NO: 13 is the determined cDNA sequence for L255C1b

SEQ ID NO: 14 is the determined cDNA sequence for L355C1.cons

SEQ ID NO: 15 is the determined cDNA sequence for L366C1.cons

SEQ ID NO: 16 is the determined cDNA sequence for L163C1a

SEQ ID NO: 17 is the determined cDNA sequence for LT86-1

SEQ ID NO: 18 is the determined cDNA sequence for LT86-2

SEQ ID NO: 19 is the determined cDNA sequence for LT86-3

SEQ ID NO: 20 is the determined cDNA sequence for LT86-4

SEQ ID NO: 21 is the determined cDNA sequence for LT86-5

SEQ ID NO: 22 is the determined cDNA sequence for LT86-6

SEQ ID NO: 23 is the determined cDNA sequence for LT86-7

SEQ ID NO: 24 is the determined cDNA sequence for LT86-8

SEQ ID NO: 25 is the determined cDNA sequence for LT86-9

SEQ ID NO: 26 is the determined cDNA sequence for LT86-10

SEQ ID NO: 27 is the determined cDNA sequence for LT86-11

SEQ ID NO: 28 is the determined cDNA sequence for LT86-12

SEQ ID NO: 29 is the determined cDNA sequence for LT86-13

SEQ ID NO: 30 is the determined cDNA sequence for LT86-14

SEQ ID NO: 31 is the determined cDNA sequence for LT86-15

SEQ ID NO: 32 is the predicted amino acid sequence for LT86-1

SEQ ID NO: 33 is the predicted amino acid sequence for LT86-2

SEQ ID NO: 34 is the predicted amino acid sequence for LT86-3

SEQ ID NO: 35 is the predicted amino acid sequence for LT86-4

SEQ ID NO: 36 is the predicted amino acid sequence for LT86-5

SEQ ID NO: 37 is the predicted amino acid sequence for LT86-6

SEQ ID NO: 38 is the predicted amino acid sequence for LT86-7

SEQ ID NO: 39 is the predicted amino acid sequence for LT86-8

SEQ ID NO: 40 is the predicted amino acid sequence for LT86-9

SEQ ID NO: 41 is the predicted amino acid sequence for LT86-10

SEQ ID NO: 42 is the predicted amino acid sequence for LT86-11

SEQ ID NO: 43 is the predicted amino acid sequence for LT86-12

SEQ ID NO: 44 is the predicted amino acid sequence for LT86-13

SEQ ID NO: 45 is the predicted amino acid sequence for LT86-14

SEQ ID NO: 46 is the predicted amino acid sequence for LT86-15

SEQ ID NO: 47 is a $(dT)_{12}AG$ primer

SEQ ID NO: 48 is a primer

SEQ ID NO: 49 is the determined 5' cDNA sequence for L86S-3

SEQ ID NO: 50 is the determined 5' cDNA sequence for L86S-12

SEQ ID NO: 51 is the determined 5' cDNA sequence for L86S-16

SEQ ID NO: 52 is the determined 5' cDNA sequence for L86S-25

SEQ ID NO: 53 is the determined 5' cDNA sequence for L86S-36

SEQ ID NO: 54 is the determined 5' cDNA sequence for L86S-40

SEQ ID NO: 55 is the determined 5' cDNA sequence for L86S-46

SEQ ID NO: 56 is the predicted amino acid sequence for L86S-3

SEQ ID NO: 57 is the predicted amino acid sequence for L86S-12

SEQ ID NO: 58 is the predicted amino acid sequence for L86S-16

SEQ ID NO: 59 is the predicted amino acid sequence for L86S-25

SEQ ID NO: 60 is the predicted amino acid sequence for L86S-36

SEQ ID NO: 61 is the predicted amino acid sequence for L86S-40

SEQ ID NO: 62 is the predicted amino acid sequence for L86S-46

SEQ ID NO: 63 is the determined 5' cDNA sequence for L86S-30

SEQ ID NO: 64 is the determined 5' cDNA sequence for L86S-41

SEQ ID NO: 65 is the predicted amino acid sequence from the 5' end of LT86-9

SEQ ID NO: 66 is the determined extended cDNA sequence for LT86-4

SEQ ID NO: 67 is the predicted extended amino acid sequence for LT86-4

SEQ ID NO: 68 is the determined 5' cDNA sequence for LT86-20

SEQ ID NO: 69 is the determined 3' cDNA sequence for LT86-21

SEQ ID NO: 70 is the determined 5' cDNA sequence for LT86-22

SEQ ID NO: 71 is the determined 5' cDNA sequence for LT86-26

SEQ ID NO: 72 is the determined 5' cDNA sequence for LT86-27

SEQ ID NO: 73 is the predicted amino acid sequence for LT86-20

SEQ ID NO: 74 is the predicted amino acid sequence for LT86-21

SEQ ID NO: 75 is the predicted amino acid sequence for LT86-22

SEQ ID NO: 76 is the predicted amino acid sequence for LT86-26

SEQ ID NO: 77 is the predicted amino acid sequence for LT86-27

SEQ ID NO: 78 is the determined extended cDNA sequence for L86S-12

SEQ ID NO: 79 is the determined extended cDNA sequence for L86S-36

SEQ ID NO: 80 is the determined extended cDNA sequence for L86S-46

SEQ ID NO: 81 is the predicted extended amino acid sequence for L86S-12

SEQ ID NO: 82 is the predicted extended amino acid sequence for L86S-36

SEQ ID NO: 83 is the predicted extended amino acid sequence for L86S-46

SEQ ID NO: 84 is the determined 5' cDNA sequence for L86S-6

SEQ ID NO: 85 is the determined 5' cDNA sequence for L86S-11

SEQ ID NO: 86 is the determined 5' cDNA sequence for L86S-14

SEQ ID NO: 87 is the determined 5' cDNA sequence for L86S-29

SEQ ID NO: 88 is the determined 5' cDNA sequence for L86S-34

SEQ ID NO: 89 is the determined 5' cDNA sequence for L86S-39

SEQ ID NO: 90 is the determined 5' cDNA sequence for L86S-47

SEQ ID NO: 91 is the determined 5' cDNA sequence for L86S-49

SEQ ID NO: 92 is the determined 5' cDNA sequence for L86S-51

SEQ ID NO: 93 is the predicted amino acid sequence for L86S-6

SEQ ID NO: 94 is the predicted amino acid sequence for L86S-11

SEQ ID NO: 95 is the predicted amino acid sequence for L86S-14

SEQ ID NO: 96 is the predicted amino acid sequence for L86S-29

SEQ ID NO: 97 is the predicted amino acid sequence for L86S-34

SEQ ID NO: 98 is the predicted amino acid sequence for L86S-39

SEQ ID NO: 99 is the predicted amino acid sequence for L86S-47

SEQ ID NO: 100 is the predicted amino acid sequence for L86S-49

SEQ ID NO: 101 is the predicted amino acid sequence for L86S-51

SEQ ID NO: 102 is the determined DNA sequence for SLT-T1

SEQ ID NO: 103 is the determined 5' cDNA sequence for SLT-T2

SEQ ID NO: 104 is the determined 5' cDNA sequence for SLT-T3

SEQ ID NO: 105 is the determined 5' cDNA sequence for SLT-T5

SEQ ID NO: 106 is the determined 5' cDNA sequence for SLT-T7

SEQ ID NO: 107 is the determined 5' cDNA sequence for SLT-T9

SEQ ID NO: 108 is the determined 5' cDNA sequence for SLT-T10

SEQ ID NO: 109 is the determined 5' cDNA sequence for SLT-T11

SEQ ID NO: 110 is the determined 5' cDNA sequence for SLT-T12

SEQ ID NO: 111 is the predicted amino acid sequence for SLT-T1

SEQ ID NO: 112 is the predicted amino acid sequence for SLT-T2

SEQ ID NO: 113 is the predicted amino acid sequence for SLT-T3

SEQ ID NO: 114 is the predicted amino acid sequence for SLT-T4

SEQ ID NO: 115 is the predicted amino acid sequence for SLT-T12

SEQ ID NO: 116 is the determined 5' cDNA sequence for SALT-T3

SEQ ID NO: 117 is the determined 5' cDNA sequence for SALT-T4

SEQ ID NO: 118 is the determined 5' cDNA sequence for SALT-T7

SEQ ID NO: 119 is the determined 5' cDNA sequence for SALT-T8

SEQ ID NO: 120 is the determined 5' cDNA sequence for SALT-T9

SEQ ID NO: 121 is the predicted amino acid sequence for SALT-T3

SEQ ID NO: 122 is the predicted amino acid sequence for SALT-T4

SEQ ID NO: 123 is the predicted amino acid sequence for SALT-T7

SEQ ID NO: 124 is the predicted amino acid sequence for SALT-T8

SEQ ID NO: 125 is the predicted amino acid sequence for SALT-T9

SEQ ID NO: 126 is the determined cDNA sequence for PSLT-1

SEQ ID NO: 127 is the determined cDNA sequence for PSLT-2

SEQ ID NO: 128 is the determined cDNA sequence for PSLT-7

SEQ ID NO: 129 is the determined cDNA sequence for PSLT-13

SEQ ID NO: 130 is the determined cDNA sequence for PSLT-27

SEQ ID NO: 131 is the determined cDNA sequence for PSLT-28

SEQ ID NO: 132 is the determined cDNA sequence for PSLT-30

SEQ ID NO: 133 is the determined cDNA sequence for PSLT-40

SEQ ID NO: 134 is the determined cDNA sequence for PSLT-69

SEQ ID NO: 135 is the determined cDNA sequence for PSLT-71

SEQ ID NO: 136 is the determined cDNA sequence for PSLT-73

SEQ ID NO: 137 is the determined cDNA sequence for PSLT-79

SEQ ID NO: 138 is the determined cDNA sequence for PSLT-03

SEQ ID NO: 139 is the determined cDNA sequence for PSLT-09

SEQ ID NO: 140 is the determined cDNA sequence for PSLT-011

SEQ ID NO: 141 is the determined cDNA sequence for PSLT-041

SEQ ID NO: 142 is the determined cDNA sequence for PSLT-62

SEQ ID NO: 143 is the determined cDNA sequence for PSLT-6

SEQ ID NO: 144 is the determined cDNA sequence for PSLT-37

SEQ ID NO: 145 is the determined cDNA sequence for PSLT-74

SEQ ID NO: 146 is the determined cDNA sequence for PSLT-010

SEQ ID NO: 147 is the determined cDNA sequence for PSLT-012

SEQ ID NO: 148 is the determined cDNA sequence for PSLT-037

SEQ ID NO: 149 is the determined 5' cDNA sequence for SAL-3

SEQ ID NO: 150 is the determined 5' cDNA sequence for SAL-24

SEQ ID NO: 151 is the determined 5' cDNA sequence for SAL-25

SEQ ID NO: 152 is the determined 5' cDNA sequence for SAL-33

SEQ ID NO: 153 is the determined 5' cDNA sequence for SAL-50

SEQ ID NO: 154 is the determined 5' cDNA sequence for SAL-57

SEQ ID NO: 155 is the determined 5' cDNA sequence for SAL-66

SEQ ID NO: 156 is the determined 5' cDNA sequence for SAL-82

SEQ ID NO: 157 is the determined 5' cDNA sequence for SAL-99

SEQ ID NO: 158 is the determined 5' cDNA sequence for SAL-104

SEQ ID NO: 159 is the determined 5' cDNA sequence for SAL-109

SEQ ID NO: 160 is the determined 5' cDNA sequence for SAL-5

SEQ ID NO: 161 is the determined 5' cDNA sequence for SAL-8

SEQ ID NO: 162 is the determined 5' cDNA sequence for SAL-12

SEQ ID NO: 163 is the determined 5' cDNA sequence for SAL-14

SEQ ID NO: 164 is the determined 5' cDNA sequence for SAL-16

SEQ ID NO: 165 is the determined 5' cDNA sequence for SAL-23

SEQ ID NO: 166 is the determined 5' cDNA sequence for SAL-26

SEQ ID NO: 167 is the determined 5' cDNA sequence for SAL-29

SEQ ID NO: 168 is the determined 5' cDNA sequence for SAL-32

SEQ ID NO: 169 is the determined 5' cDNA sequence for SAL-39

SEQ ID NO: 170 is the determined 5' cDNA sequence for SAL-42

SEQ ID NO: 171 is the determined 5' cDNA sequence for SAL-43

SEQ ID NO: 172 is the determined 5' cDNA sequence for SAL-44

SEQ ID NO: 173 is the determined 5' cDNA sequence for SAL-48

SEQ ID NO: 174 is the determined 5' cDNA sequence for SAL-68

SEQ ID NO: 175 is the determined 5' cDNA sequence for SAL-72

SEQ ID NO: 176 is the determined 5' cDNA sequence for SAL-77

SEQ ID NO: 177 is the determined 5' cDNA sequence for SAL-86

SEQ ID NO: 178 is the determined 5' cDNA sequence for SAL-88

SEQ ID NO: 179 is the determined 5' cDNA sequence for SAL-93

SEQ ID NO: 180 is the determined 5' cDNA sequence for SAL-100

SEQ ID NO: 181 is the determined 5' cDNA sequence for SAL-105

SEQ ID NO: 182 is the predicted amino acid sequence for SAL-3

SEQ ID NO: 183 is the predicted amino acid sequence for SAL-24

SEQ ID NO: 184 is a first predicted amino acid sequence for SAL-25

SEQ ID NO: 185 is a second predicted amino acid sequence for SAL-25

SEQ ID NO: 186 is the predicted amino acid sequence for SAL-33

SEQ ID NO: 187 is a first predicted amino acid sequence for SAL-50

SEQ ID NO: 188 is the predicted amino acid sequence for SAL-57

SEQ ID NO: 189 is a first predicted amino acid sequence for SAL-66

SEQ ID NO: 190 is a second predicted amino acid sequence for SAL-66

SEQ ID NO: 191 is the predicted amino acid sequence for SAL-82

SEQ ID NO: 192 is the predicted amino acid sequence for SAL-99

SEQ ID NO: 193 is the predicted amino acid sequence for SAL-104

SEQ ID NO: 194 is the predicted amino acid sequence for SAL-5

SEQ ID NO: 195 is the predicted amino acid sequence for SAL-8

SEQ ID NO: 196 is the predicted amino acid sequence for SAL-12

SEQ ID NO: 197 is the predicted amino acid sequence for SAL-14

SEQ ID NO: 198 is the predicted amino acid sequence for SAL-16

SEQ ID NO: 199 is the predicted amino acid sequence for SAL-23

SEQ ID NO: 200 is the predicted amino acid sequence for SAL-26

SEQ ID NO: 201 is the predicted amino acid sequence for SAL-29

SEQ ID NO: 202 is the predicted amino acid sequence for SAL-32

SEQ ID NO: 203 is the predicted amino acid sequence for SAL-39

SEQ ID NO: 204 is the predicted amino acid sequence for SAL-42

SEQ ID NO: 205 is the predicted amino acid sequence for SAL-43

SEQ ID NO: 206 is the predicted amino acid sequence for SAL-44

SEQ ID NO: 207 is the predicted amino acid sequence for SAL-48

SEQ ID NO: 208 is the predicted amino acid sequence for SAL-68

SEQ ID NO: 209 is the predicted amino acid sequence for SAL-72

SEQ ID NO: 210 is the predicted amino acid sequence for SAL-77

SEQ ID NO: 211 is the predicted amino acid sequence for SAL-86

SEQ ID NO: 212 is the predicted amino acid sequence for SAL-88

SEQ ID NO: 213 is the predicted amino acid sequence for SAL-93

SEQ ID NO: 214 is the predicted amino acid sequence for SAL-100

SEQ ID NO: 215 is the predicted amino acid sequence for SAL-105

SEQ ID NO: 216 is a second predicted amino acid sequence for SAL-50

SEQ ID NO: 217 is the determined cDNA sequence for SSLT-4

SEQ ID NO: 218 is the determined cDNA sequence for SSLT-9

SEQ ID NO: 219 is the determined cDNA sequence for SSLT-10

SEQ ID NO: 220 is the determined cDNA sequence for SSLT-12

SEQ ID NO: 221 is the determined cDNA sequence for SSLT-19

SEQ ID NO: 222 is the determined cDNA sequence for SSLT-31

SEQ ID NO: 223 is the determined cDNA sequence for SSLT-38

SEQ ID NO: 224 is the determined cDNA sequence for LT4690-2

SEQ ID NO: 225 is the determined cDNA sequence for LT4690-3

SEQ ID NO: 226 is the determined cDNA sequence for LT4690-22

SEQ ID NO: 227 is the determined cDNA sequence for LT4690-24

SEQ ID NO: 228 is the determined cDNA sequence for LT4690-37

SEQ ID NO: 229 is the determined cDNA sequence for LT4690-39

SEQ ID NO: 230 is the determined cDNA sequence for LT4690-40

SEQ ID NO: 231 is the determined cDNA sequence for LT4690-41

SEQ ID NO: 232 is the determined cDNA sequence for LT4690-49

SEQ ID NO: 233 is the determined 3' cDNA sequence for LT4690-55

SEQ ID NO: 234 is the determined 5' cDNA sequence for LT4690-55

SEQ ID NO: 235 is the determined cDNA sequence for LT4690-59

SEQ ID NO: 236 is the determined cDNA sequence for LT4690-63

SEQ ID NO: 237 is the determined cDNA sequence for LT4690-71

SEQ ID NO: 238 is the determined cDNA sequence for 2LT-3

SEQ ID NO: 239 is the determined cDNA sequence for 2LT-6

SEQ ID NO: 240 is the determined cDNA sequence for 2LT-22

SEQ ID NO: 241 is the determined cDNA sequence for 2LT-25

SEQ ID NO: 242 is the determined cDNA sequence for 2LT-26

SEQ ID NO: 243 is the determined cDNA sequence for 2LT-31

SEQ ID NO: 244 is the determined cDNA sequence for 2LT-36

SEQ ID NO: 245 is the determined cDNA sequence for 2LT-42

SEQ ID NO: 246 is the determined cDNA sequence for 2LT-44

SEQ ID NO: 247 is the determined cDNA sequence for 2LT-54

SEQ ID NO: 248 is the determined cDNA sequence for 2LT-55

SEQ ID NO: 249 is the determined cDNA sequence for 2LT-57

SEQ ID NO: 250 is the determined cDNA sequence for 2LT-58

SEQ ID NO: 251 is the determined cDNA sequence for 2LT-59

SEQ ID NO: 252 is the determined cDNA sequence for 2LT-62

SEQ ID NO: 253 is the determined cDNA sequence for 2LT-63

SEQ ID NO: 254 is the determined cDNA sequence for 2LT-65

SEQ ID NO: 255 is the determined cDNA sequence for 2LT-66

SEQ ID NO: 256 is the determined cDNA sequence for 2LT-70

SEQ ID NO: 257 is the determined cDNA sequence for 2LT-73

SEQ ID NO: 258 is the determined cDNA sequence for 2LT-74

SEQ ID NO: 259 is the determined cDNA sequence for 2LT-76

SEQ ID NO: 260 is the determined cDNA sequence for 2LT-77

SEQ ID NO: 261 is the determined cDNA sequence for 2LT-78

SEQ ID NO: 262 is the determined cDNA sequence for 2LT-80

SEQ ID NO: 263 is the determined cDNA sequence for 2LT-85

SEQ ID NO: 264 is the determined cDNA sequence for 2LT-87

SEQ ID NO: 265 is the determined cDNA sequence for 2LT-89

SEQ ID NO: 266 is the determined cDNA sequence for 2LT-94

SEQ ID NO: 267 is the determined cDNA sequence for 2LT-95

SEQ ID NO: 268 is the determined cDNA sequence for 2LT-98

SEQ ID NO: 269 is the determined cDNA sequence for 2LT-100

SEQ ID NO: 270 is the determined cDNA sequence for 2LT-103

SEQ ID NO: 271 is the determined cDNA sequence for 2LT-105

SEQ ID NO: 272 is the determined cDNA sequence for 2LT-107

SEQ ID NO: 273 is the determined cDNA sequence for 2LT-108

SEQ ID NO: 274 is the determined cDNA sequence for 2LT-109

SEQ ID NO: 275 is the determined cDNA sequence for 2LT-118

SEQ ID NO: 276 is the determined cDNA sequence for 2LT-120

SEQ ID NO: 277 is the determined cDNA sequence for 2LT-121

SEQ ID NO: 278 is the determined cDNA sequence for 2LT-122

SEQ ID NO: 279 is the determined cDNA sequence for 2LT-124

SEQ ID NO: 280 is the determined cDNA sequence for 2LT-126

SEQ ID NO: 281 is the determined cDNA sequence for 2LT-127

SEQ ID NO: 282 is the determined cDNA sequence for 2LT-128

SEQ ID NO: 283 is the determined cDNA sequence for 2LT-129

SEQ ID NO: 284 is the determined cDNA sequence for 2LT-133

SEQ ID NO: 285 is the determined cDNA sequence for 2LT-137

SEQ ID NO: 286 is the determined cDNA sequence for LT4690-71

SEQ ID NO: 287 is the determined cDNA sequence for LT4690-82

SEQ ID NO: 288 is the determined full-length cDNA sequence for SSLT-74

SEQ ID NO: 289 is the determined cDNA sequence for SSLT-78

SEQ ID NO: 290 is the determined cDNA sequence for SCC1-8.

SEQ ID NO: 291 is the determined cDNA sequence for SCC1-12

SEQ ID NO: 292 is the determined cDNA sequence for SCC1-336

SEQ ID NO: 293 is the determined cDNA sequence for SCC1-344

SEQ ID NO: 294 is the determined cDNA sequence for SCC1-345

SEQ ID NO: 295 is the determined cDNA sequence for SCC1-346

SEQ ID NO: 296 is the determined cDNA sequence for SCC1-348

SEQ ID NO: 297 is the determined cDNA sequence for SCC1-350

SEQ ID NO: 298 is the determined cDNA sequence for SCC1-352

SEQ ID NO: 299 is the determined cDNA sequence for SCC1-354

SEQ ID NO: 300 is the determined cDNA sequence for SCC1-355

SEQ ID NO: 301 is the determined cDNA sequence for SCC1-356

SEQ ID NO: 302 is the determined cDNA sequence for SCC1-357

SEQ ID NO: 303 is the determined cDNA sequence for SCC1-501

SEQ ID NO: 304 is the determined cDNA sequence for SCC1-503

SEQ ID NO: 305 is the determined cDNA sequence for SCC1-513

SEQ ID NO: 306 is the determined cDNA sequence for SCC1-516

SEQ ID NO: 307 is the determined cDNA sequence for SCC1-518

SEQ ID NO: 308 is the determined cDNA sequence for SCC1-519

SEQ ID NO: 309 is the determined cDNA sequence for SCC1-522

SEQ ID NO: 310 is the determined cDNA sequence for SCC1-523

SEQ ID NO: 311 is the determined cDNA sequence for SCC1-525

SEQ ID NO: 312 is the determined cDNA sequence for SCC1-527

SEQ ID NO: 313 is the determined cDNA sequence for SCC1-529

SEQ ID NO: 314 is the determined cDNA sequence for SCC1-530

SEQ ID NO: 315 is the determined cDNA sequence for SCC1-531

SEQ ID NO: 316 is the determined cDNA sequence for SCC1-532

SEQ ID NO: 317 is the determined cDNA sequence for SCC1-533

SEQ ID NO: 318 is the determined cDNA sequence for SCC1-536

SEQ ID NO: 319 is the determined cDNA sequence for SCC1-538

SEQ ID NO: 320 is the determined cDNA sequence for SCC1-539

SEQ ID NO: 321 is the determined cDNA sequence for SCC1-541

SEQ ID NO: 322 is the determined cDNA sequence for SCC1-542

SEQ ID NO: 323 is the determined cDNA sequence for SCC1-546

SEQ ID NO: 324 is the determined cDNA sequence for SCC1-549

SEQ ID NO: 325 is the determined cDNA sequence for SCC1-551

SEQ ID NO: 326 is the determined cDNA sequence for SCC1-552

SEQ ID NO: 327 is the determined cDNA sequence for SCC1-554

SEQ ID NO: 328 is the determined cDNA sequence for SCC1-558

SEQ ID NO: 329 is the determined cDNA sequence for SCC1-559

SEQ ID NO: 330 is the determined cDNA sequence for SCC1-561

SEQ ID NO: 331 is the determined cDNA sequence for SCC1-562

SEQ ID NO: 332 is the determined cDNA sequence for SCC1-564

SEQ ID NO: 333 is the determined cDNA sequence for SCC1-565

SEQ ID NO: 334 is the determined cDNA sequence for SCC1-566

SEQ ID NO: 335 is the determined cDNA sequence for SCC1-567

SEQ ID NO: 336 is the determined cDNA sequence for SCC1-568

SEQ ID NO: 337 is the determined cDNA sequence for SCC1-570

SEQ ID NO: 338 is the determined cDNA sequence for SCC1-572

SEQ ID NO: 339 is the determined cDNA sequence for SCC1-575

SEQ ID NO: 340 is the determined cDNA sequence for SCC1-576

SEQ ID NO: 341 is the determined cDNA sequence for SCC1-577

SEQ ID NO: 342 is the determined cDNA sequence for SCC1-578

SEQ ID NO: 343 is the determined cDNA sequence for SCC1-582

SEQ ID NO: 344 is the determined cDNA sequence for SCC1-583

SEQ ID NO: 345 is the determined cDNA sequence for SCC1-586

SEQ ID NO: 346 is the determined cDNA sequence for SCC1-588

SEQ ID NO: 347 is the determined cDNA sequence for SCC1-590

SEQ ID NO: 348 is the determined cDNA sequence for SCC1-591

SEQ ID NO: 349 is the determined cDNA sequence for SCC1-592

SEQ ID NO: 350 is the determined cDNA sequence for SCC1-593

SEQ ID NO: 351 is the determined cDNA sequence for SCC1-594

SEQ ID NO: 352 is the determined cDNA sequence for SCC1-595

SEQ ID NO: 353 is the determined cDNA sequence for SCC1-596

SEQ ID NO: 354 is the determined cDNA sequence for SCC1-598

SEQ ID NO: 355 is the determined cDNA sequence for SCC1-599

SEQ ID NO: 356 is the determined cDNA sequence for SCC1-602

SEQ ID NO: 357 is the determined cDNA sequence for SCC1-604

SEQ ID NO: 358 is the determined cDNA sequence for SCC1-605

SEQ ID NO: 359 is the determined cDNA sequence for SCC1-606

SEQ ID NO: 360 is the determined cDNA sequence for SCC1-607

SEQ ID NO: 361 is the determined cDNA sequence for SCC1-608

SEQ ID NO: 362 is the determined cDNA sequence for SCC1-610

SEQ ID NO: 363 is the determined cDNA sequence for clone DMS79T1

SEQ ID NO: 364 is the determined cDNA sequence for clone DMS79T2

SEQ ID NO: 365 is the determined cDNA sequence for clone DMS79T3

SEQ ID NO: 366 is the determined cDNA sequence for clone DMS79T5

SEQ ID NO: 367 is the determined cDNA sequence for clone DMS79T6

SEQ ID NO: 368 is the determined cDNA sequence for clone DMS79T7

SEQ ID NO: 369 is the determined cDNA sequence for clone DMS79T9

SEQ ID NO: 370 is the determined cDNA sequence for clone DMS79T10

SEQ ID NO: 371 is the determined cDNA sequence for clone DMS79T11

SEQ ID NO: 372 is the determined cDNA sequence for clone 128T1

SEQ ID NO: 373 is the determined cDNA sequence for clone 128T2

SEQ ID NO: 374 is the determined cDNA sequence for clone 128T3

SEQ ID NO: 375 is the determined cDNA sequence for clone 128T4

SEQ ID NO: 376 is the determined cDNA sequence for clone 128T5

SEQ ID NO: 377 is the determined cDNA sequence for clone 128T7

SEQ ID NO: 378 is the determined cDNA sequence for clone 128T9

SEQ ID NO: 379 is the determined cDNA sequence for clone 128T10

SEQ ID NO: 380 is the determined cDNA sequence for clone 128T11

SEQ ID NO: 381 is the determined cDNA sequence for clone 128T12

SEQ ID NO: 382 is the determined cDNA sequence for clone NCIH69T3

SEQ ID NO: 383 is the determined cDNA sequence for clone NCIH69T5

SEQ ID NO: 384 is the determined cDNA sequence for clone NCIH69T6

SEQ ID NO: 385 is the determined cDNA sequence for clone NCIH69T7

SEQ ID NO: 386 is the determined cDNA sequence for clone NCIH69T9

SEQ ID NO: 387 is the determined cDNA sequence for clone NCIH69T10

SEQ ID NO: 388 is the determined cDNA sequence for clone NCIH69T11

SEQ ID NO: 389 is the determined cDNA sequence for clone NCIH69T12

SEQ ID NO: 390 is the full-length cDNA sequence for 128T1

SEQ ID NO: 391 is the amino acid sequence for 128T1

SEQ ID NO: 392 is the full-length cDNA sequence for 2LT-128

SEQ ID NO: 393 is the amino acid sequence for 2LT-128

SEQ ID NO: 394 is an extended cDNA sequence for clone SCC1-542

SEQ ID NO: 395 is the amino acid sequence corresponding to

SEQ ID NO: 394

SEQ ID NO: 396 is an extended cDNA sequence for clone SCC1-593

SEQ ID NO: 397 is the amino acid sequence corresponding to

SEQ ID NO: 396

SEQ ID NO: 398 is the determined cDNA sequence for 55508.1

SEQ ID NO: 399 is the determined cDNA sequence for 55509.1

SEQ ID NO: 400 is the determined cDNA sequence for 54243.1

SEQ ID NO: 401 is the determined cDNA sequence for 54251.1

SEQ ID NO: 402 is the determined cDNA sequence for 54252.1

SEQ ID NO: 403 is the determined cDNA sequence for 54253.1

SEQ ID NO: 404 is the determined cDNA sequence for 55518.1

SEQ ID NO: 405 is the determined cDNA sequence for 54258.1

SEQ ID NO: 406 is the determined cDNA sequence for 54575.1

SEQ ID NO: 407 is the determined cDNA sequence for 54577.1

SEQ ID NO: 408 is the determined cDNA sequence for 54584.1

SEQ ID NO: 409 is the determined cDNA sequence for 55521.1

SEQ ID NO: 410 is the determined cDNA sequence for 54589.1

SEQ ID NO: 411 is the determined cDNA sequence for 54592.1

SEQ ID NO: 412 is the determined cDNA sequence for 55134.1

SEQ ID NO: 413 is the determined cDNA sequence for 55137.1

SEQ ID NO: 414 is the determined cDNA sequence for 55140.1

SEQ ID NO: 415 is the determined cDNA sequence for 55531.1

SEQ ID NO: 416 is the determined cDNA sequence for 55532.1

SEQ ID NO: 417 is the determined cDNA sequence for 54621.1

SEQ ID NO: 418 is the determined cDNA sequence for 55548.1

SEQ ID NO: 419 is the determined cDNA sequence for 54623.1

SEQ ID NO: 420 is the determined cDNA sequence for L39

SEQ ID NO: 421 is the predicted amino acid sequence for L39

SEQ ID NO: 422 is the determined cDNA sequence for SCC2-29

SEQ ID NO: 423 is the determined cDNA sequence for SCC2-36

SEQ ID NO: 424 is the determined cDNA sequence for SCC2-60

SEQ ID NO: 425 is the predicted amino acid sequence for SCC2-29

SEQ ID NO: 426 is the predicted amino acid sequence for SCC2-36

SEQ ID NO: 427 is the predicted amino acid sequence for SCC2-60

SEQ ID NO: 428 is an extended cDNA sequence for the clone 20129, also referred to as 2LT-3, set forth in SEQ ID NO: 238

SEQ ID NO: 429 is an extended cDNA sequence for the clone 20347, also referred to as 2LT-26, set forth in SEQ ID NO: 242

SEQ ID NO: 430 is an extended cDNA sequence for the clone 21282, also referred to as 2LT-57, set forth in SEQ ID NO: 249

SEQ ID NO: 431 is an extended cDNA sequence for the clone 21283, also referred to as 2LT-58, set forth in SEQ ID NO: 250

SEQ ID NO: 432 is an extended cDNA sequence for the clone 21484, also referred to as 2LT-98, set forth in SEQ ID NO: 268

SEQ ID NO: 433 is an extended cDNA sequence for the clone 21871, also referred to as 2LT-124, set forth in SEQ ID NO: 279

SEQ ID NO: 434 is an amino acid sequence encoded by SEQ ID NO: 428

SEQ ID NO: 435 is an amino acid sequence encoded by SEQ ID NO: 429

SEQ ID NO: 436 is an amino acid sequence encoded by SEQ ID NO: 430

SEQ ID NO: 437 is an amino acid sequence encoded by SEQ ID NO: 431

SEQ ID NO: 438 is an amino acid sequence encoded by SEQ ID NO: 432

SEQ ID NO: 439 is an amino acid sequence encoded by SEQ ID NO: 433

SEQ ID NO: 440 is the determined cDNA sequence for clone 19A4.

SEQ ID NO: 441 is the determined full-length cDNA sequence for clone 14F10.

SEQ ID NO: 442 is the determined 5' cDNA sequence for clone 20E10.

SEQ ID NO: 443 is a first determined cDNA sequence for clone 55153.

SEQ ID NO: 444 is a second determined cDNA sequence for clone 55153.

SEQ ID NO: 445 is a first determined cDNA sequence for clone 55154.

SEQ ID NO: 446 is a second determined cDNA sequence for clone 55154.

SEQ ID NO: 447 is the determined cDNA sequence for clone 55155.

SEQ ID NO: 448 is a first determined cDNA sequence for clone 55156.

SEQ ID NO: 449 is a second determined cDNA sequence for clone 55156.

SEQ ID NO: 450 is a first determined cDNA sequence for clone 55157.

SEQ ID NO: 451 is a second determined cDNA sequence for clone 55157.

SEQ ID NO: 452 is the determined cDNA sequence for clone 55158.

SEQ ID NO: 453 is the determined cDNA sequence for clone 55159.

SEQ ID NO: 454 is a first determined cDNA sequence for clone 55161.

SEQ ID NO: 455 is a second determined cDNA sequence for clone 55161.

SEQ ID NO: 456 is a first determined cDNA sequence for clone 55162.

SEQ ID NO: 457 is a second determined cDNA sequence for clone 55162.

SEQ ID NO: 458 is a first determined cDNA sequence for clone 55163.

SEQ ID NO: 459 is a second determined cDNA sequence for clone 55163.

SEQ ID NO: 460 is a first determined cDNA sequence for clone 55164.

SEQ ID NO: 461 is a second determined cDNA sequence for clone 55164.

SEQ ID NO: 462 is a first determined cDNA sequence for clone 55165.

SEQ ID NO: 463 is a second determined cDNA sequence for clone 55165.

SEQ ID NO: 464 is a first determined cDNA sequence for clone 55166.

SEQ ID NO: 465 is a second determined cDNA sequence for clone 55166.

SEQ ID NO: 466 is a first determined cDNA sequence for clone 55167.

SEQ ID NO: 467 is a second determined cDNA sequence for clone 55167.

SEQ ID NO: 468 is a first determined cDNA sequence for clone 55168.

SEQ ID NO: 469 is a second determined cDNA sequence for clone 55168.

SEQ ID NO: 470 is a first determined cDNA sequence for clone 55169.

SEQ ID NO: 471 is a second determined cDNA sequence for clone 55169.

SEQ ID NO: 472 is a first determined cDNA sequence for clone 55170.

SEQ ID NO: 473 is a second determined cDNA sequence for clone 55170.

SEQ ID NO: 474 is the determined cDNA sequence for clone 55171.

SEQ ID NO: 475 is the determined cDNA sequence for clone 55172.

SEQ ID NO: 476 is the determined cDNA sequence for clone 55173.

SEQ ID NO: 477 is a first determined cDNA sequence for clone 55174.

SEQ ID NO: 478 is a second determined cDNA sequence for clone 55174.

SEQ ID NO: 479 is the determined cDNA sequence for clone 55175.

SEQ ID NO: 480 is the determined cDNA sequence for clone 55176.

SEQ ID NO: 481 is the determined cDNA sequence for contig 525.

SEQ ID NO: 482 is the determined cDNA sequence for contig 526.

SEQ ID NO: 483 is the determined cDNA sequence for contig 527.

SEQ ID NO: 484 is the determined cDNA sequence for contig 528.

SEQ ID NO: 485 is the determined cDNA sequence for contig 529.

SEQ ID NO: 486 is the determined cDNA sequence for contig 530.

SEQ ID NO: 487 is the determined cDNA sequence for contig 531.

SEQ ID NO: 488 is the determined cDNA sequence for contig 532.

SEQ ID NO: 489 is the determined cDNA sequence for contig 533.

SEQ ID NO: 490 is the determined cDNA sequence for contig 534.

SEQ ID NO: 491 is the determined cDNA sequence for contig 535.

SEQ ID NO: 492 is the determined cDNA sequence for contig 536.

SEQ ID NO: 493 is the determined cDNA sequence for contig 537.

SEQ ID NO: 494 is the determined cDNA sequence for contig 538.

SEQ ID NO: 495 is the determined cDNA sequence for contig 539.

SEQ ID NO: 496 is the determined cDNA sequence for contig 540.
SEQ ID NO: 497 is the determined cDNA sequence for contig 541.
SEQ ID NO: 498 is the determined cDNA sequence for contig 542.
SEQ ID NO: 499 is the determined cDNA sequence for contig 543.
SEQ ID NO: 500 is the determined cDNA sequence for contig 544.
SEQ ID NO: 501 is the determined cDNA sequence for contig 545.
SEQ ID NO: 502 is the determined cDNA sequence for contig 546.
SEQ ID NO: 503 is the determined cDNA sequence for contig 547.
SEQ ID NO: 504 is the determined cDNA sequence for contig 548.
SEQ ID NO: 505 is the determined cDNA sequence for contig 549.
SEQ ID NO: 506 is the determined cDNA sequence for contig 550.
SEQ ID NO: 507 is the determined cDNA sequence for contig 551.
SEQ ID NO: 508 is the determined cDNA sequence for contig 552.
SEQ ID NO: 509 is the determined cDNA sequence for contig 553.
SEQ ID NO: 510 is the determined cDNA sequence for contig 554.
SEQ ID NO: 511 is the determined cDNA sequence for contig 555.
SEQ ID NO: 512 is the determined cDNA sequence for clone 57207.
SEQ ID NO: 513 is the determined cDNA sequence for clone 57209.
SEQ ID NO: 514 is the determined cDNA sequence for clone 57210.
SEQ ID NO: 515 is the determined cDNA sequence for clone 57211.
SEQ ID NO: 516 is the determined cDNA sequence for clone 57212.
SEQ ID NO: 517 is the determined cDNA sequence for clone 57213.
SEQ ID NO: 518 is the determined cDNA sequence for clone 57215.
SEQ ID NO: 519 is the determined cDNA sequence for clone 57219.
SEQ ID NO: 520 is the determined cDNA sequence for clone 57221.
SEQ ID NO: 521 is the determined cDNA sequence for clone 57222.
SEQ ID NO: 522 is the determined cDNA sequence for clone 57223.
SEQ ID NO: 523 is the determined cDNA sequence for clone 57225.
SEQ ID NO: 524 is the determined cDNA sequence for clone 57227.
SEQ ID NO: 525 is the determined cDNA sequence for clone 57228.
SEQ ID NO: 526 is the determined cDNA sequence for clone 57229.
SEQ ID NO: 527 is the determined cDNA sequence for clone 57230.
SEQ ID NO: 528 is the determined cDNA sequence for clone 57231.
SEQ ID NO: 529 is the determined cDNA sequence for clone 57232.
SEQ ID NO: 530 is the determined cDNA sequence for clone 57233.
SEQ ID NO: 531 is the determined cDNA sequence for clone 57234.
SEQ ID NO: 532 is the determined cDNA sequence for clone 57235.
SEQ ID NO: 533 is the determined cDNA sequence for clone 57236.
SEQ ID NO: 534 is the determined cDNA sequence for clone 57237.
SEQ ID NO: 535 is the determined cDNA sequence for clone 57238.
SEQ ID NO: 536 is the determined cDNA sequence for clone 57239.
SEQ ID NO: 537 is the determined cDNA sequence for clone 57240.
SEQ ID NO: 538 is the determined cDNA sequence for clone 57242.
SEQ ID NO: 539 is the determined cDNA sequence for clone 57243.
SEQ ID NO: 540 is the determined cDNA sequence for clone 57245.
SEQ ID NO: 541 is the determined cDNA sequence for clone 57248.
SEQ ID NO: 542 is the determined cDNA sequence for clone 57249.
SEQ ID NO: 543 is the determined cDNA sequence for clone 57250.
SEQ ID NO: 544 is the determined cDNA sequence for clone 57251.
SEQ ID NO: 545 is the determined cDNA sequence for clone 57253.
SEQ ID NO: 546 is the determined cDNA sequence for clone 57254.
SEQ ID NO: 547 is the determined cDNA sequence for clone 57255.
SEQ ID NO: 548 is the determined cDNA sequence for clone 57257.
SEQ ID NO: 549 is the determined cDNA sequence for clone 57258.
SEQ ID NO: 550 is the determined cDNA sequence for clone 57259.
SEQ ID NO: 551 is the determined cDNA sequence for clone 57261.
SEQ ID NO: 552 is the determined cDNA sequence for clone 57262.
SEQ ID NO: 553 is the determined cDNA sequence for clone 57263.
SEQ ID NO: 554 is the determined cDNA sequence for clone 57264.
SEQ ID NO: 555 is the determined cDNA sequence for clone 57265.
SEQ ID NO: 556 is the determined cDNA sequence for clone 57266.
SEQ ID NO: 557 is the determined cDNA sequence for clone 57267.

SEQ ID NO: 558 is the determined cDNA sequence for clone 57268.
SEQ ID NO: 559 is the determined cDNA sequence for clone 57269.
SEQ ID NO: 560 is the determined cDNA sequence for clone 57270.
SEQ ID NO: 561 is the determined cDNA sequence for clone 57271.
SEQ ID NO: 562 is the determined cDNA sequence for clone 57272.
SEQ ID NO: 563 is the determined cDNA sequence for clone 57274.
SEQ ID NO: 564 is the determined cDNA sequence for clone 57275.
SEQ ID NO: 565 is the determined cDNA sequence for clone 57277.
SEQ ID NO: 566 is the determined cDNA sequence for clone 57280.
SEQ ID NO: 567 is the determined cDNA sequence for clone 57281.
SEQ ID NO: 568 is the determined cDNA sequence for clone 57282.
SEQ ID NO: 569 is the determined cDNA sequence for clone 57283.
SEQ ID NO: 570 is the determined cDNA sequence for clone 57285.
SEQ ID NO: 571 is the determined cDNA sequence for clone 57287.
SEQ ID NO: 572 is the determined cDNA sequence for clone 57288.
SEQ ID NO: 573 is the determined cDNA sequence for clone 57289.
SEQ ID NO: 574 is the determined cDNA sequence for clone 57290.
SEQ ID NO: 575 is the determined cDNA sequence for clone 57292.
SEQ ID NO: 576 is the determined cDNA sequence for clone 57295.
SEQ ID NO: 577 is the determined cDNA sequence for clone 57296.
SEQ ID NO: 578 is the determined cDNA sequence for clone 57297.
SEQ ID NO: 579 is the determined cDNA sequence for clone 57299.
SEQ ID NO: 580 is the determined cDNA sequence for clone 57301.
SEQ ID NO: 581 is the determined cDNA sequence for clone 57302.
SEQ ID NO: 582 is the determined cDNA sequence for the beta chain of a lung tumor specific T cell receptor.
SEQ ID NO: 583 is the determined cDNA sequence for the alpha chain of a lung tumor specific T cell receptor.
SEQ ID NO: 584 is the amino acid sequence encoded by SEQ ID NO: 583.
SEQ ID NO: 585 is the amino acid sequence encoded by SEQ ID NO: 582.
SEQ ID NO: 586 is the amino acid sequence encoded by the 5' terminus of 14F10.
SEQ ID NO: 587 is the amino acid sequence of a T cell epitope contained within SEQ ID NO: 586.
SEQ ID NO:588 is the determined cDNA sequence for 54533
SEQ ID NO:589 is the determined cDNA sequence for 54534
SEQ ID NO:590 is the determined cDNA sequence for 54536
SEQ ID NO:591 is the determined cDNA sequence for 54538
SEQ ID NO:592 is the determined cDNA sequence for 54540
SEQ ID NO:593 is the determined cDNA sequence for 55084
SEQ ID NO:594 is the determined cDNA sequence for 55086
SEQ ID NO:595 is the determined cDNA sequence for 54555
SEQ ID NO:596 is the determined cDNA sequence for 54557
SEQ ID NO:597 is the determined cDNA sequence for 54564
SEQ ID NO:598 is the determined cDNA sequence for 55098
SEQ ID NO:599 is the determined cDNA sequence for 55473
SEQ ID NO:600 is the determined cDNA sequence for 55104
SEQ ID NO:601 is the determined cDNA sequence for 55105
SEQ ID NO:602 is the determined cDNA sequence for 55107
SEQ ID NO:603 is the determined cDNA sequence for 55108
SEQ ID NO:604 is the determined cDNA sequence for 55114
SEQ ID NO:605 is the determined cDNA sequence for 55477
SEQ ID NO:606 is the determined cDNA sequence for 55482
SEQ ID NO:607 is the determined cDNA sequence for 55483
SEQ ID NO:608 is the determined cDNA sequence for 55485
SEQ ID NO:609 is the determined cDNA sequence for 55487
SEQ ID NO:610 is the determined cDNA sequence for 55488
SEQ ID NO:611 is the determined cDNA sequence for 55087
SEQ ID NO:612 is the determined cDNA sequence for 55089
SEQ ID NO:613 is the determined cDNA sequence for 55092
SEQ ID NO:614 is the determined cDNA sequence for 55093
SEQ ID NO:615 is the determined cDNA sequence for 56926
SEQ ID NO:616 is the determined cDNA sequence for 56930
SEQ ID NO:617 is the determined cDNA sequence for 56944
SEQ ID NO:618 is the determined cDNA sequence for 56945
SEQ ID NO:619 is the determined cDNA sequence for 55490

SEQ ID NO:620 is the determined cDNA sequence for 55495

SEQ ID NO:621 is the determined cDNA sequence for 55504

SEQ ID NO:622 is the determined cDNA sequence for 55506

SEQ ID NO:623 is the determined cDNA sequence for 56480

SEQ ID NO:624 is the determined cDNA sequence for 56482

SEQ ID NO:625 is the determined cDNA sequence for 56484

SEQ ID NO:626 is the determined cDNA sequence for 56487

SEQ ID NO:627 is the determined cDNA sequence for 56488

SEQ ID NO:628 is the determined cDNA sequence for 56490

SEQ ID NO:629 is the determined cDNA sequence for 56493

SEQ ID NO:630 is the determined cDNA sequence for 56494

SEQ ID NO:631 is the determined cDNA sequence for 56495

SEQ ID NO:632 is the determined cDNA sequence for 56499

SEQ ID NO:633 is the determined cDNA sequence for 56517

SEQ ID NO:634 is the determined cDNA sequence for 56952

SEQ ID NO:635 is the determined cDNA sequence for 56953

SEQ ID NO:636 is the determined cDNA sequence for 56959

SEQ ID NO:637 is the determined cDNA sequence for 57139

SEQ ID NO:638 is the determined cDNA sequence for 57078

SEQ ID NO:639 is the determined cDNA sequence for 57092

SEQ ID NO:640 is the determined cDNA sequence for 57099

SEQ ID NO:641 is the determined cDNA sequence for 57100

SEQ ID NO:642 is the determined cDNA sequence for 57105

SEQ ID NO:643 is the determined cDNA sequence for 57111

SEQ ID NO:644 is the determined cDNA sequence for 57117

SEQ ID NO:645 is the determined cDNA sequence for 57121

SEQ ID NO:646 is the determined cDNA sequence for 57124

SEQ ID NO:647 is the determined cDNA sequence for 57125

SEQ ID NO:648–686 are the determined cDNA sequences for the clones described in Tables 9–10.

SEQ ID NO:687–727 are the determined cDNA sequences for the clones described in Tables 11–13.

SEQ ID NO:728 is the determined full-length cDNA sequence for clone DMS39 (partial sequence given in SEQ ID NO:695).

SEQ ID NO:729 is the determined full-length cDNA sequence for clone DMS 126 partial sequence given in SEQ ID NO:708).

SEQ ID NO:730 is the determined full-length cDNA sequence for clone DMS218 (partial sequence given in SEQ ID NO:720).

SEQ ID NO:731 is the determined full-length cDNA sequence for clone DMS253 (partial sequence given in SEQ ID NO:723).

SEQ ID NO:732 is the determined full-length cDNA sequence for clone LSCC-86 (partial sequence given in SEQ ID NO:665).

SEQ ID NO:733 is a first amino acid sequence encoded by SEQ ID NO:732 and designated LSCC-86protein1.

SEQ ID NO:734 is a second amino acid sequence encoded by SEQ ID NO:732 and designated LSCC-86protein2.

SEQ ID NO:735 is a third amino acid sequence encoded by SEQ ID NO:732 and designated LSCC-86protein3.

DETAILED DESCRIPTION OF THE INVENTION

The present invention is directed generally to compositions and their use in the therapy and diagnosis of cancer, particularly lung cancer. As described further below, illustrative compositions of the present invention include, but are not restricted to, polypeptides, particularly immunogenic polypeptides, polynucleotides encoding such polypeptides, antibodies and other binding agents, antigen presenting cells (APCs) and immune system cells (e.g., T cells).

The practice of the present invention will employ, unless indicated specifically to the contrary, conventional methods of virology, immunology, microbiology, molecular biology and recombinant DNA techniques within the skill of the art, many of which are described below for the purpose of illustration. Such techniques are explained fully in the literature. See, e.g., Sambrook, et al. Molecular Cloning: A Laboratory Manual (2nd Edition, 1989); Maniatis et al. Molecular Cloning: A Laboratory Manual (1982); DNA Cloning: A Practical Approach, vol. I & II (D. Glover, ed.); Oligonucleotide Synthesis (N. Gait, ed., 1984); Nucleic Acid Hybridization (B. Hames & S. Higgins, eds., 1985); Transcription and Translation (B. Hames & S. Higgins, eds., 1984); Animal Cell Culture (R. Freshney, ed., 1986); Perbal, A Practical Guide to Molecular Cloning (1984).

All publications, patents and patent applications cited herein, whether supra or infra, are hereby incorporated by reference in their entirety.

As used in this specification and the appended claims, the singular forms "a," "an" and "the" include plural references unless the content clearly dictates otherwise.

Polypeptide Compositions

As used herein, the term "polypeptide" " is used in its conventional meaning, i.e., as a sequence of amino acids. The polypeptides are not limited to a specific length of the product; thus, peptides, oligopeptides, and proteins are included within the definition of polypeptide, and such terms may be used interchangeably herein unless specifically indicated otherwise. This term also does not refer to or exclude post-expression modifications of the polypeptide, for example, glycosylations, acetylations, phosphorylations and the like, as well as other modifications known in the art, both naturally occurring and non-naturally occurring. A polypeptide may be an entire protein, or a subsequence thereof. Particular polypeptides of interest in the context of this invention are amino acid subsequences comprising epitopes, i.e., antigenic determinants substantially responsible for the immunogenic properties of a polypeptide and being capable of evoking an immune response.

Particularly illustrative polypeptides of the present invention comprise those encoded by a polynucleotide sequence set forth in any one of SEQ ID NOs: 217–390, 392, 394, 396, 398–420 422–424, 428–433, 440–583 and 588–732, or a sequence that hybridizes under moderately stringent conditions, or, alternatively, under highly stringent conditions, to a polynucleotide sequence set forth in any one of SEQ ID NOs: 217–390, 392, 394, 396, 398–420 422–424, 428–433, 440–583 and 588–732. Certain other illustrative polypeptides of the invention comprise amino acid sequences as set forth in any one of SEQ ID NOs: 391, 393, 395, 397, 421, 425–427, 434–439, 584–587 and.

The polypeptides of the present invention are sometimes herein referred to as lung tumor proteins or lung tumor polypeptides, as an indication that their identification has been based at least in part upon their increased levels of expression in lung tumor samples. Thus, a "lung tumor polypeptide" or "lung tumor protein," refers generally to a polypeptide sequence of the present invention, or a polynucleotide sequence encoding such a polypeptide, that is expressed in a substantial proportion of lung tumor samples, for example preferably greater than about 20%, more preferably greater than about 30%, and most preferably greater than about 50% or more of lung tumor samples tested, at a level that is at least two fold, and preferably at least five fold, greater than the level of expression in normal tissues, as determined using a representative assay provided herein. A lung tumor polypeptide sequence of the invention, based upon its increased level of expression in tumor cells, has particular utility both as a diagnostic marker as well as a therapeutic target, as further described below.

In certain preferred embodiments, the polypeptides of the invention are immunogenic, i.e., they react detectably within an immunoassay (such as an ELISA or T-cell stimulation assay) with antisera and/or T-cells from a patient with lung cancer. Screening for immunogenic activity can be performed using techniques well known to the skilled artisan. For example, such screens can be performed using methods such as those described in Harlow and Lane, *Antibodies: A Laboratory Manual*, Cold Spring Harbor Laboratory, 1988. In one illustrative example, a polypeptide may be immobilized on a solid support and contacted with patient sera to allow binding of antibodies within the sera to the immobilized polypeptide. Unbound sera may then be removed and bound antibodies detected using, for example, $^{125}$I-labeled Protein A.

As would be recognized by the skilled artisan, immunogenic portions of the polypeptides disclosed herein are also encompassed by the present invention. An "immunogenic portion," as used herein, is a fragment of an immunogenic polypeptide of the invention that itself is immunologically reactive (i.e., specifically binds) with the B-cells and/or T-cell surface antigen receptors that recognize the polypeptide. Immunogenic portions may generally be identified using well known techniques, such as those summarized in Paul, *Fundamental Immunology*, 3rd ed., 243–247 (Raven Press, 1993) and references cited therein. Such techniques include screening polypeptides for the ability to react with antigen-specific antibodies, antisera and/or T-cell lines or clones. As used herein, antisera and antibodies are "antigen-specific" if they specifically bind to an antigen (i.e., they react with the protein in an ELISA or other immunoassay, and do not react detectably with unrelated proteins). Such antisera and antibodies may be prepared as described herein, and using well-known techniques.

In one preferred embodiment, an immunogenic portion of a polypeptide of the present invention is a portion that reacts with antisera and/or T-cells at a level that is not substantially less than the reactivity of the full-length polypeptide (e.g., in an ELISA and/or T-cell reactivity assay). Preferably, the level of immunogenic activity of the immunogenic portion is at least about 50%, preferably at least about 70% and most preferably greater than about 90% of the immunogenicity for the full-length polypeptide. In some instances, preferred immunogenic portions will be identified that have a level of immunogenic activity greater than that of the corresponding full-length polypeptide, e.g., having greater than about 100% or 150% or more immunogenic activity.

In certain other embodiments, illustrative immunogenic portions may include peptides in which an N-terminal leader sequence and/or transmembrane domain have been deleted. Other illustrative immunogenic portions will contain a small N- and/or C-terminal deletion (e.g., 1–30 amino acids, preferably 5–15 amino acids), relative to the mature protein.

In another embodiment, a polypeptide composition of the invention may also comprise one or more polypeptides that are immunologically reactive with T cells and/or antibodies generated against a polypeptide of the invention, particularly a polypeptide having an amino acid sequence disclosed herein, or to an immunogenic fragment or variant thereof.

In another embodiment of the invention, polypeptides are provided that comprise one or more polypeptides that are capable of eliciting T cells and/or antibodies that are immunologically reactive with one or more polypeptides described herein, or one or more polypeptides encoded by contiguous nucleic acid sequences contained in the polynucleotide sequences disclosed herein, or immunogenic fragments or variants thereof, or to one or more nucleic acid sequences which hybridize to one or more of these sequences under conditions of moderate to high stringency.

The present invention, in another aspect, provides polypeptide fragments comprising at least about 5, 10, 15, 20, 25, 50, or 100 contiguous amino acids, or more, including all intermediate lengths, of a polypeptide compositions set forth herein, such as those set forth in SEQ ID NOs: 391, 393, 395, 397, 421, 425–427, 434–439, 584–587 and, or those encoded by a polynucleotide sequence set forth in a sequence of SEQ ID NOs: 217–390, 392, 394, 396, 398–420 422–424, 428–433, 440–583 and 588–732.

In another aspect, the present invention provides variants of the polypeptide compositions described herein. Polypeptide variants generally encompassed by the present invention will typically exhibit at least about 70%, 75%, 80%, 85%, 90%, 91%, 92%, 93%, 94%, 95%, 96%, 97%, 98%, or 99% or more identity (determined as described below), along its length, to a polypeptide sequences set forth herein.

In one preferred embodiment, the polypeptide fragments and variants provide by the present invention are immunologically reactive with an antibody and/or T-cell that reacts with a full-length polypeptide specifically set for the herein.

In another preferred embodiment, the polypeptide fragments and variants provided by the present invention exhibit a level of immunogenic activity of at least about 50%, preferably at least about 70%, and most preferably at least about 90% or more of that exhibited by a full-length polypeptide sequence specifically set forth herein.

A polypeptide "variant," as the term is used herein, is a polypeptide that typically differs from a polypeptide specifically disclosed herein in one or more substitutions, deletions, additions and/or insertions. Such variants may be naturally occurring or may be synthetically generated, for example, by modifying one or more of the above polypeptide sequences of the invention and evaluating their immunogenic activity as described herein and/or using any of a number of techniques well known in the art.

For example, certain illustrative variants of the polypeptides of the invention include those in which one or more portions, such as an N-terminal leader sequence or transmembrane domain, have been removed. Other illustrative variants include variants in which a small portion (e.g., 1–30 amino acids, preferably 5–15 amino acids) has been removed from the N- and/or C-terminal of the mature protein.

In many instances, a variant will contain conservative substitutions. A "conservative substitution" is one in which an amino acid is substituted for another amino acid that has similar properties, such that one skilled in the art of peptide chemistry would expect the secondary structure and hydropathic nature of the polypeptide to be substantially unchanged. As described above, modifications may be made in the structure of the polynucleotides and polypeptides of the present invention and still obtain a functional molecule that encodes a variant or derivative polypeptide with desirable characteristics, e.g., with immunogenic characteristics. When it is desired to alter the amino acid sequence of a polypeptide to create an equivalent, or even an improved, immunogenic variant or portion of a polypeptide of the invention, one skilled in the art will typically change one or more of the codons of the encoding DNA sequence according to Table 1.

For example, certain amino acids may be substituted for other amino acids in a protein structure without appreciable loss of interactive binding capacity with structures such as, for example, antigen-binding regions of antibodies or binding sites on substrate molecules. Since it is the interactive capacity and nature of a protein that defines that protein's biological functional activity, certain amino acid sequence substitutions can be made in a protein sequence, and, of course, its underlying DNA coding sequence, and nevertheless obtain a protein with like properties. It is thus contemplated that various changes may be made in the peptide sequences of the disclosed compositions, or corresponding DNA sequences which encode said peptides without appreciable loss of their biological utility or activity.

TABLE 1

| Amino Acids | | | Codons | | | | | |
|---|---|---|---|---|---|---|---|---|
| Alanine | Ala | A | GCA | GCC | GCG | GCU | | |
| Cysteine | Cys | C | UGC | UGU | | | | |
| Aspartic acid | Asp | D | GAC | GAU | | | | |
| Glutamic acid | Glu | E | GAA | GAG | | | | |
| Phenylalanine | Phe | F | UUC | UUU | | | | |
| Glycine | Gly | G | GGA | GGC | GGG | GGU | | |
| Histidine | His | H | CAC | CAU | | | | |
| Isoleucine | Ile | I | AUA | AUC | AUU | | | |
| Lysine | Lys | K | AAA | AAG | | | | |
| Leucine | Leu | L | UUA | UUG | CUA | CUC | CUG | CUU |
| Methionine | Met | M | AUG | | | | | |
| Asparagine | Asn | N | AAC | AAU | | | | |
| Proline | Pro | P | CCA | CCC | CCG | CCU | | |
| Glutamine | Gln | Q | CAA | CAG | | | | |
| Arginine | Arg | R | AGA | AGG | CGA | CGC | CGG | CGU |
| Serine | Ser | S | AGC | AGU | UCA | UCC | UCG | UCU |
| Threonine | Thr | T | ACA | ACC | ACG | ACU | | |
| Valine | Val | V | GUA | GUC | GUG | GUU | | |
| Tryptophan | Trp | W | UGG | | | | | |
| Tyrosine | Tyr | Y | UAC | UAU | | | | |

In making such changes, the hydropathic index of amino acids may be considered. The importance of the hydropathic amino acid index in conferring interactive biologic function on a protein is generally understood in the art (Kyte and Doolittle, 1982, incorporated herein by reference). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like. Each amino acid has been assigned a hydropathic index on the basis of its hydrophobicity and charge characteristics (Kyte and Doolittle, 1982). These values are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

It is known in the art that certain amino acids may be substituted by other amino acids having a similar hydropathic index or score and still result in a protein with similar biological activity, i.e. still obtain a biological functionally equivalent protein. In making such changes, the substitution of amino acids whose hydropathic indices are within ±2 is preferred, those within ±1 are particularly preferred, and those within ±0.5 are even more particularly preferred. It is also understood in the art that the substitution of like amino acids can be made effectively on the basis of hydrophilicity. U.S. Pat. No. 4,554,101 (specifically incorporated herein by reference in its entirety), states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4). It is understood that an amino acid can be substituted for another having a similar hydrophilicity value and still obtain a biologically equivalent, and in particular, an immunologically equivalent protein. In such changes, the substitution of amino acids whose hydrophilicity values are within ±2 is preferred, those within ±1 are particularly preferred, and those within ±0.5 are even more particularly preferred.

As outlined above, amino acid substitutions are generally therefore based on the relative similarity of the amino acid side-chain substituents, for example, their hydrophobicity, hydrophilicity, charge, size, and the like. Exemplary substitutions that take various of the foregoing characteristics into consideration are well known to those of skill in the art and include: arginine and lysine; glutamate and aspartate; serine and threonine; glutamine and asparagine; and valine, leucine and isoleucine.

In addition, any polynucleotide may be further modified to increase stability in vivo. Possible modifications include, but are not limited to, the addition of flanking sequences at the 5' and/or 3' ends; the use of phosphorothioate or 2' O-methyl rather than phosphodiesterase linkages in the backbone; and/or the inclusion of nontraditional bases such as inosine, queosine and wybutosine, as well as acetyl-methyl-, thio- and other modified forms of adenine, cytidine, guanine, thymine and uridine.

Amino acid substitutions may further be made on the basis of similarity in polarity, charge, solubility, hydrophobicity, hydrophilicity and/or the amphipathic nature of the residues. For example, negatively charged amino acids include aspartic acid and glutamic acid; positively charged amino acids include lysine and arginine; and amino acids with uncharged polar head groups having similar hydrophilicity values include leucine, isoleucine and valine; glycine and alanine; asparagine and glutamine; and serine, threonine, phenylalanine and tyrosine. Other groups of amino acids that may represent conservative changes include: (1) ala, pro, gly, glu, asp, gln, asn, ser, thr; (2) cys, ser, tyr, thr; (3) val, ile, leu, met, ala, phe; (4) lys, arg, his; and (5) phe, tyr, trp, his. A variant may also, or alternatively, contain nonconservative changes. In a preferred embodiment, variant polypeptides differ from a native sequence by substitution, deletion or addition of five amino acids or fewer. Variants may also (or alternatively) be modified by, for example, the deletion or addition of amino acids that have minimal influence on the immunogenicity, secondary structure and hydropathic nature of the polypeptide.

As noted above, polypeptides may comprise a signal (or leader) sequence at the N-terminal end of the protein, which co-translationally or post-translationally directs transfer of the protein. The polypeptide may also be conjugated to a linker or other sequence for ease of synthesis, purification or identification of the polypeptide (e.g., poly-His), or to enhance binding of the polypeptide to a solid support. For example, a polypeptide may be conjugated to an immunoglobulin Fc region.

When comparing polypeptide sequences, two sequences are said to be "identical" if the sequence of amino acids in the two sequences is the same when aligned for maximum correspondence, as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O. (1978) A model of evolutionary change in proteins—Matrices for detecting distant relationships. In Dayhoff, M. O. (ed.) Atlas of Protein Sequence and Structure, National Biomedical Research Foundation, Washington D.C. Vol. 5, Suppl. 3, pp. 345–358; Hein J. (1990) Unified Approach to Alignment and Phylogenes pp. 626–645 *Methods in Enzymology* vol. 183, Academic Press, Inc., San Diego, Calif.; Higgins, D. G. and Sharp, P. M. (1989) *CABIOS* 5:151–153; Myers, E. W. and Muller W. (1988) *CABIOS* 4:11–17; Robinson, E. D. (1971) *Comb. Theor* 11:105; Santou, N. Nes, M. (1987) *Mol. Biol. Evol.* 4:406–425; Sneath, P. H. A. and Sokal, R. R. (1973) *Numerical Taxonomy—the Principles and Practice of Numerical Taxonomy*, Freeman Press, San Francisco, Calif.; Wilbur, W. J. and Lipman, D. J. (1983) *Proc. Natl. Acad., Sci. USA* 80:726–730.

Alternatively, optimal alignment of sequences for comparison may be conducted by the local identity algorithm of Smith and Waterman (1981) *Add. APL. Math* 2:482, by the identity alignment algorithm of Needleman and Wunsch (1970) *J. Mol. Biol.* 48:443, by the search for similarity methods of Pearson and Lipman (1988) *Proc. Natl. Acad. Sci. USA* 85: 2444, by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection.

One preferred example of algorithms that are suitable for determining percent sequence identity and sequence similarity are the BLAST and BLAST 2.0 algorithms, which are described in Altschul et al. (1977) *Nucl. Acids Res.* 25:3389–3402 and Altschul et al. (1990) *J. Mol. Biol.* 215:403–410, respectively. BLAST and BLAST 2.0 can be used, for example with the parameters described herein, to determine percent sequence identity for the polynucleotides and polypeptides of the invention. Software for performing BLAST analyses is publicly available through the National Center for Biotechnology Information. For amino acid sequences, a scoring matrix can be used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment.

In one preferred approach, the "percentage of sequence identity" is determined by comparing two optimally aligned sequences over a window of comparison of at least 20 positions, wherein the portion of the polypeptide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical amino acid residue occurs in both sequences to yield the number of matched positions, dividing the number of matched positions by the total number of positions in the reference sequence (i.e., the window size) and multiplying the results by 100 to yield the percentage of sequence identity.

Within other illustrative embodiments, a polypeptide may be a fusion polypeptide that comprises multiple polypeptides as described herein, or that comprises at least one polypeptide as described herein and an unrelated sequence, such as a known tumor protein. A fusion partner may, for example, assist in providing T helper epitopes (an immunological fusion partner), preferably T helper epitopes recognized by humans, or may assist in expressing the protein (an expression enhancer) at higher yields than the native recombinant protein. Certain preferred fusion partners are both immunological and expression enhancing fusion partners. Other fusion partners may be selected so as to increase the solubility of the polypeptide or to enable the polypeptide to be targeted to desired intracellular compartments. Still further fusion partners include affinity tags, which facilitate purification of the polypeptide.

Fusion polypeptides may generally be prepared using standard techniques, including chemical conjugation. Preferably, a fusion polypeptide is expressed as a recombinant polypeptide, allowing the production of increased levels, relative to a non-fused polypeptide, in an expression system. Briefly, DNA sequences encoding the polypeptide components may be assembled separately, and ligated into an appropriate expression vector. The 3' end of the DNA sequence encoding one polypeptide component is ligated, with or without a peptide linker, to the 5' end of a DNA sequence encoding the second polypeptide component so that the reading frames of the sequences are in phase. This permits translation into a single fusion polypeptide that retains the biological activity of both component polypeptides.

A peptide linker sequence may be employed to separate the first and second polypeptide components by a distance sufficient to ensure that each polypeptide folds into its secondary and tertiary structures. Such a peptide linker sequence is incorporated into the fusion polypeptide using standard techniques well known in the art. Suitable peptide linker sequences may be chosen based on the following factors: (1) their ability to adopt a flexible extended conformation; (2) their inability to adopt a secondary structure that could interact with functional epitopes on the first and second polypeptides; and (3) the lack of hydrophobic or charged residues that might react with the polypeptide functional epitopes. Preferred peptide linker sequences contain Gly, Asn and Ser residues. Other near neutral amino acids, such as Thr and Ala may also be used in the linker sequence. Amino acid sequences which may be usefully employed as linkers include those disclosed in Maratea et al., Gene 40:39–46, 1985; Murphy et al., Proc. Natl. Acad. Sci. USA 83:8258–8262, 1986; U.S. Pat. No. 4,935,233 and U.S. Pat. No. 4,751,180. The linker sequence may generally be from 1 to about 50 amino acids in length. Linker sequences are not required when the first and second polypeptides have non-essential N-terminal amino acid regions that can be used to separate the functional domains and prevent steric interference.

The ligated DNA sequences are operably linked to suitable transcriptional or translational regulatory elements. The regulatory elements responsible for expression of DNA are located only 5' to the DNA sequence encoding the first polypeptides. Similarly, stop codons required to end translation and transcription termination signals are only present 3' to the DNA sequence encoding the second polypeptide.

The fusion polypeptide can comprise a polypeptide as described herein together with an unrelated immunogenic protein, such as an immunogenic protein capable of eliciting a recall response. Examples of such proteins include tetanus, tuberculosis and hepatitis proteins (see, for example, Stoute et al. New Engl. J. Med., 336:86–91, 1997).

In one preferred embodiment, the immunological fusion partner is derived from a Mycobacterium sp., such as a Mycobacterium tuberculosis-derived Ra12 fragment. Ra12 compositions and methods for their use in enhancing the expression and/or immunogenicity of heterologous polynucleotide/polypeptide sequences is described in U.S. Patent Application 60/158,585, the disclosure of which is incorporated herein by reference in its entirety. Briefly, Ra12 refers to a polynucleotide region that is a subsequence of a Mycobacterium tuberculosis MTB32A nucleic acid. MTB32A is a serine protease of 32 KD molecular weight encoded by a gene in virulent and avirulent strains of M. tuberculosis. The nucleotide sequence and amino acid sequence of MTB32A have been described (for example, U.S. Patent Application 60/158,585; see also, Skeiky et al., Infection and Immun. (1999) 67:3998–4007, incorporated herein by reference). C-terminal fragments of the MTB32A coding sequence express at high levels and remain as a soluble polypeptides throughout the purification process. Moreover, Ra12 may enhance the immunogenicity of heterologous immunogenic polypeptides with which it is fused. One preferred Ra12 fusion polypeptide comprises a 14 KD C-terminal fragment corresponding to amino acid residues 192 to 323 of MTB32A. Other preferred Ra12 polynucleotides generally comprise at least about 15 consecutive nucleotides, at least about 30 nucleotides, at least about 60 nucleotides, at least about 100 nucleotides, at least about 200 nucleotides, or at least about 300 nucleotides that encode a portion of a Ra12 polypeptide. Ra12 polynucleotides may comprise a native sequence (i.e., an endogenous sequence that encodes a Ra12 polypeptide or a portion thereof) or may comprise a variant of such a sequence. Ra12 polynucleotide variants may contain one or more substitutions, additions, deletions and/or insertions such that the biological activity of the encoded fusion polypeptide is not substantially diminished, relative to a fusion polypeptide comprising a native Ra12 polypeptide. Variants preferably exhibit at least about 70% identity, more preferably at least about 80% identity and most preferably at least about 90% identity to a polynucleotide sequence that encodes a native Ra12 polypeptide or a portion thereof.

Within other preferred embodiments, an immunological fusion partner is derived from protein D, a surface protein of the gram-negative bacterium Haemophilus influenza B (WO 91/18926). Preferably, a protein D derivative comprises approximately the first third of the protein (e.g., the first N-terminal 100–110 amino acids), and a protein D derivative may be lipidated. Within certain preferred embodiments, the first 109 residues of a Lipoprotein D fusion partner is included on the N-terminus to provide the polypeptide with additional exogenous T-cell epitopes and to increase the expression level in E. coli (thus functioning as an expression enhancer). The lipid tail ensures optimal presentation of the antigen to antigen presenting cells. Other fusion partners include the non-structural protein from influenzae virus, NS1 (hemaglutinin). Typically, the N-terminal 81 amino acids are used, although different fragments that include T-helper epitopes may be used.

In another embodiment, the immunological fusion partner is the protein known as LYTA, or a portion thereof (preferably a C-terminal portion). LYTA is derived from Streptococcus pneumoniae, which synthesizes an N-acetyl-L-alanine amidase known as amidase LYTA (encoded by the LytA gene; Gene 43:265–292, 1986). LYTA is an autolysin that specifically degrades certain bonds in the peptidoglycan backbone. The C-terminal domain of the LYTA protein is responsible for the affinity to the choline or to some choline analogues such as DEAE. This property has been exploited for the development of E. coli C-LYTA expressing plasmids useful for expression of fusion proteins. Purification of hybrid proteins containing the C-LYTA fragment at the amino terminus has been described (see Biotechnology 10:795–798, 1992). Within a preferred embodiment, a repeat portion of LYTA may be incorporated into a fusion polypeptide. A repeat portion is found in the C-terminal region starting at residue 178. A particularly preferred repeat portion incorporates residues 188–305.

Yet another illustrative embodiment involves fusion polypeptides, and the polynucleotides encoding them, wherein the fusion partner comprises a targeting signal capable of directing a polypeptide to the endosomal/lysosomal compartment, as described in U.S. Pat. No. 5,633,234. An immunogenic polypeptide of the invention, when fused with this targeting signal, will associate more efficiently with MHC class II molecules and thereby provide enhanced in vivo stimulation of $CD4^+$ T-cells specific for the polypeptide.

Polypeptides of the invention are prepared using any of a variety of well known synthetic and/or recombinant techniques, the latter of which are further described below.

Polypeptides, portions and other variants generally less than about 150 amino acids can be generated by synthetic means, using techniques well known to those of ordinary skill in the art. In one illustrative example, such polypeptides are synthesized using any of the commercially available solid-phase techniques, such as the Merrifield solid-phase synthesis method, where amino acids are sequentially added to a growing amino acid chain. See Merrifield, *J. Am. Chem. Soc.* 85:2149–2146, 1963. Equipment for automated synthesis of polypeptides is commercially available from suppliers such as Perkin Elmer/Applied BioSystems Division (Foster City, Calif.), and may be operated according to the manufacturer's instructions.

In general, polypeptide compositions (including fusion polypeptides) of the invention are isolated. An "isolated" polypeptide is one that is removed from its original environment. For example, a naturally-occurring protein or polypeptide is isolated if it is separated from some or all of the coexisting materials in the natural system. Preferably, such polypeptides are also purified, e.g., are at least about 90% pure, more preferably at least about 95% pure and most preferably at least about 99% pure.

Polynucleotide Compositions

The present invention, in other aspects, provides polynucleotide compositions. The terms "DNA" and "polynucleotide" are used essentially interchangeably herein to refer to a DNA molecule that has been isolated free of total genomic DNA of a particular species. "Isolated," as used herein, means that a polynucleotide is substantially away from other coding sequences, and that the DNA molecule does not contain large portions of unrelated coding DNA, such as large chromosomal fragments or other functional genes or polypeptide coding regions. Of course, this refers to the DNA molecule as originally isolated, and does not exclude genes or coding regions later added to the segment by the hand of man.

As will be understood by those skilled in the art, the polynucleotide compositions of this invention can include genomic sequences, extra-genomic and plasmid-encoded sequences and smaller engineered gene segments that express, or may be adapted to express, proteins, polypeptides, peptides and the like. Such segments may be naturally isolated, or modified synthetically by the hand of man.

As will be also recognized by the skilled artisan, polynucleotides of the invention may be single-stranded (coding or antisense) or double-stranded, and may be DNA (genomic, cDNA or synthetic) or RNA molecules. RNA molecules may include HnRNA molecules, which contain introns and correspond to a DNA molecule in a one-to-one manner, and mRNA molecules, which do not contain introns. Additional coding or non-coding sequences may, but need not, be present within a polynucleotide of the present invention, and a polynucleotide may, but need not, be linked to other molecules and/or support materials.

Polynucleotides may comprise a native sequence (i.e., an endogenous sequence that encodes a polypeptide/protein of the invention or a portion thereof) or may comprise a sequence that encodes a variant or derivative, preferably and immunogenic variant or derivative, of such a sequence.

Therefore, according to another aspect of the present invention, polynucleotide compositions are provided that comprise some or all of a polynucleotide sequence set forth in any one of SEQ ID NOs: 217–390, 392, 394, 396, 398–420 422–424, 428–433, 440–583 and 588–732, complements of a polynucleotide sequence set forth in any one of SEQ ID NOs: 217–390, 392, 394, 396, 398–420 422–424, 428–433, 440–583 and 588–732, and degenerate variants of a polynucleotide sequence set forth in any one of SEQ ID NOs: 217–390, 392, 394, 396, 398–420 422–424, 428–433, 440–583 and 588–732. In certain preferred embodiments, the polynucleotide sequences set forth herein encode immunogenic polypeptides, as described above.

In other related embodiments, the present invention provides polynucleotide variants having substantial identity to the sequences disclosed herein in SEQ ID NOs: 217–390, 392, 394, 396, 398–420 422–424, 428–433, 440–583 and 588–732, for example those comprising at least 70% sequence identity, preferably at least 75%, 80%, 85%, 90%, 95%, 96%, 97%, 98%, or 99% or higher, sequence identity compared to a polynucleotide sequence of this invention using the methods described herein, (e.g., BLAST analysis using standard parameters, as described below). One skilled in this art will recognize that these values can be appropriately adjusted to determine corresponding identity of proteins encoded by two nucleotide sequences by taking into account codon degeneracy, amino acid similarity, reading frame positioning and the like.

Typically, polynucleotide variants will contain one or more substitutions, additions, deletions and/or insertions, preferably such that the immunogenicity of the polypeptide encoded by the variant polynucleotide is not substantially diminished relative to a polypeptide encoded by a polynucleotide sequence specifically set forth herein). The term "variants" should also be understood to encompasses homologous genes of xenogenic origin.

In additional embodiments, the present invention provides polynucleotide fragments comprising various lengths of contiguous stretches of sequence identical to or complementary to one or more of the sequences disclosed herein. For example, polynucleotides are provided by this invention that comprise at least about 10, 15, 20, 30, 40, 50, 75, 100, 150, 200, 300, 400, 500 or 1000 or more contiguous nucleotides of one or more of the sequences disclosed herein as well as all intermediate lengths there between. It will be readily understood that "intermediate lengths", in this context, means any length between the quoted values, such as 16, 17, 18, 19, etc.; 21, 22, 23, etc.; 30, 31, 32, etc.; 50, 51, 52, 53, etc.; 100, 101, 102, 103, etc.; 150, 151, 152, 153, etc.; including all integers through 200–500; 500–1,000, and the like.

In another embodiment of the invention, polynucleotide compositions are provided that are capable of hybridizing under moderate to high stringency conditions to a polynucleotide sequence provided herein, or a fragment thereof, or a complementary sequence thereof. Hybridization techniques are well known in the art of molecular biology. For purposes of illustration, suitable moderately stringent conditions for testing the hybridization of a polynucleotide of this invention with other polynucleotides include prewashing in a solution of 5×SSC, 0.5% SDS, 1.0 mM EDTA (pH 8.0); hybridizing at 50° C.–60° C., 5×SSC, overnight; followed by washing twice at 65° C. for 20 minutes with each of 2×, 0.5× and 0.2×SSC containing 0.1% SDS. One skilled in the art will understand that the stringency of hybridization can be readily manipulated, such as by altering the salt content of the hybridization solution and/or the temperature at which the hybridization is performed. For example, in another embodiment, suitable highly stringent hybridization conditions include those described above, with the exception that the temperature of hybridization is increased, e.g., to 60–65° C. or 65–70° C.

In certain preferred embodiments, the polynucleotides described above, e.g., polynucleotide variants, fragments and hybridizing sequences, encode polypeptides that are immunologically cross-reactive with a polypeptide sequence specifically set forth herein. In other preferred embodiments, such polynucleotides encode polypeptides that have a level of immunogenic activity of at least about 50%, preferably at least about 70%, and more preferably at least about 90% of that for a polypeptide sequence specifically set forth herein.

The polynucleotides of the present invention, or fragments thereof, regardless of the length of the coding sequence itself, may be combined with other DNA sequences, such as promoters, polyadenylation signals, additional restriction enzyme sites, multiple cloning sites, other coding segments, and the like, such that their overall length may vary considerably. It is therefore contemplated that a nucleic acid fragment of almost any length may be employed, with the total length preferably being limited by the ease of preparation and use in the intended recombinant DNA protocol. For example, illustrative polynucleotide segments with total lengths of about 10,000, about 5000, about 3000, about 2,000, about 1,000, about 500, about 200, about 100, about 50 base pairs in length, and the like, (including all intermediate lengths) are contemplated to be useful in many implementations of this invention.

When comparing polynucleotide sequences, two sequences are said to be "identical" if the sequence of nucleotides in the two sequences is the same when aligned for maximum correspondence, as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O. (1978) A model of evolutionary change in proteins—Matrices for detecting distant relationships. In Dayhoff, M. O. (ed.) Atlas of Protein Sequence and Structure, National Biomedical Research Foundation, Washington D.C. Vol. 5, Suppl. 3, pp. 345–358; Hein J. (1990) Unified Approach to Alignment and Phylogenes pp. 626–645 *Methods in Enzymology vol.* 183, Academic Press, Inc., San Diego, Calif.; Higgins, D. G. and Sharp, P. M. (1989) *CABIOS* 5:151–153; Myers, E. W. and Muller W. (1988) *CABIOS* 4:11–17; Robinson, E. D. (1971) *Comb. Theor* 11:105; Santou, N. Nes, M. (1987) *Mol. Biol. Evol.* 4:406–425; Sneath, P. H. A. and Sokal, R. R. (1973) *Numerical Taxonomy—the Principles and Practice of Numerical Taxonomy*, Freeman Press, San Francisco, Calif.; Wilbur, W. J. and Lipman, D. J. (1983) *Proc. Natl. Acad., Sci. USA* 80:726–730.

Alternatively, optimal alignment of sequences for comparison may be conducted by the local identity algorithm of Smith and Waterman (1981) *Add. APL. Math* 2:482, by the identity alignment algorithm of Needleman and Wunsch (1970) *J. Mol. Biol.* 48:443, by the search for similarity methods of Pearson and Lipman (1988) *Proc. Natl. Acad. Sci. USA* 85: 2444, by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection.

One preferred example of algorithms that are suitable for determining percent sequence identity and sequence similarity are the BLAST and BLAST 2.0 algorithms, which are described in Altschul et al. (1977) *Nucl. Acids Res.* 25:3389–3402 and Altschul et al. (1990) *J. Mol. Biol.* 215:403–410, respectively. BLAST and BLAST 2.0 can be used, for example with the parameters described herein, to determine percent sequence identity for the polynucleotides of the invention. Software for performing BLAST analyses is publicly available through the National Center for Biotechnology Information. In one illustrative example, cumulative scores can be calculated using, for nucleotide sequences, the parameters M (reward score for a pair of matching residues; always >0) and N (penalty score for mismatching residues; always <0). Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a wordlength (W) of 11, and expectation (E) of 10, and the BLOSUM62 scoring matrix (see Henikoff and Henikoff (1989) *Proc. Natl. Acad. Sci. USA* 89:10915) alignments, (B) of 50, expectation (E) of 10, M=5, N=−4 and a comparison of both strands.

Preferably, the "percentage of sequence identity" is determined by comparing two optimally aligned sequences over a window of comparison of at least 20 positions, wherein the portion of the polynucleotide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical nucleic acid bases occurs in both sequences to yield the number of matched positions, dividing the number of matched positions by the total number of positions in the reference sequence (i.e., the window size) and multiplying the results by 100 to yield the percentage of sequence identity.

It will be appreciated by those of ordinary skill in the art that, as a result of the degeneracy of the genetic code, there are many nucleotide sequences that encode a polypeptide as described herein. Some of these polynucleotides bear minimal homology to the nucleotide sequence of any native gene. Nonetheless, polynucleotides that vary due to differences in codon usage are specifically contemplated by the present invention. Further, alleles of the genes comprising the polynucleotide sequences provided herein are within the scope of the present invention. Alleles are endogenous genes that are altered as a result of one or more mutations, such as deletions, additions and/or substitutions of nucleotides. The resulting mRNA and protein may, but need not, have an altered structure or function. Alleles may be identified using standard techniques (such as hybridization, amplification and/or database sequence comparison).

Therefore, in another embodiment of the invention, a mutagenesis approach, such as site-specific mutagenesis, is employed for the preparation of immunogenic variants and/or derivatives of the polypeptides described herein. By this approach, specific modifications in a polypeptide sequence can be made through mutagenesis of the underlying polynucleotides that encode them. These techniques provides a straightforward approach to prepare and test sequence variants, for example, incorporating one or more of the foregoing considerations, by introducing one or more nucleotide sequence changes into the polynucleotide.

Site-specific mutagenesis allows the production of mutants through the use of specific oligonucleotide sequences which encode the DNA sequence of the desired mutation, as well as a sufficient number of adjacent nucleotides, to provide a primer sequence of sufficient size and sequence complexity to form a stable duplex on both sides of the deletion junction being traversed. Mutations may be employed in a selected polynucleotide sequence to improve, alter, decrease, modify, or otherwise change the properties of the polynucleotide itself, and/or alter the properties, activity, composition, stability, or primary sequence of the encoded polypeptide.

In certain embodiments of the present invention, the inventors contemplate the mutagenesis of the disclosed polynucleotide sequences to alter one or more properties of the encoded polypeptide, such as the immunogenicity of a polypeptide vaccine. The techniques of site-specific mutagenesis are well known in the art, and are widely used to create variants of both polypeptides and polynucleotides. For example, site-specific mutagenesis is often used to alter a specific portion of a DNA molecule. In such embodiments, a primer comprising typically about 14 to about 25 nucleotides or so in length is employed, with about 5 to about 10 residues on both sides of the junction of the sequence being altered.

As will be appreciated by those of skill in the art, site-specific mutagenesis techniques have often employed a phage vector that exists in both a single stranded and double stranded form. Typical vectors useful in site-directed mutagenesis include vectors such as the M13 phage. These phage are readily commercially-available and their use is generally well-known to those skilled in the art. Double-stranded plasmids are also routinely employed in site directed mutagenesis that eliminates the step of transferring the gene of interest from a plasmid to a phage.

In general, site-directed mutagenesis in accordance herewith is performed by first obtaining a single-stranded vector or melting apart of two strands of a double-stranded vector that includes within its sequence a DNA sequence that encodes the desired peptide. An oligonucleotide primer bearing the desired mutated sequence is prepared, generally synthetically. This primer is then annealed with the single-stranded vector, and subjected to DNA polymerizing enzymes such as E. coli polymerase I Klenow fragment, in order to complete the synthesis of the mutation-bearing strand. Thus, a heteroduplex is formed wherein one strand encodes the original non-mutated sequence and the second strand bears the desired mutation. This heteroduplex vector is then used to transform appropriate cells, such as E. coli cells, and clones are selected which include recombinant vectors bearing the mutated sequence arrangement.

The preparation of sequence variants of the selected peptide-encoding DNA segments using site-directed mutagenesis provides a means of producing potentially useful species and is not meant to be limiting as there are other ways in which sequence variants of peptides and the DNA sequences encoding them may be obtained. For example, recombinant vectors encoding the desired peptide sequence may be treated with mutagenic agents, such as hydroxylamine, to obtain sequence variants. Specific details regarding these methods and protocols are found in the teachings of Maloy et al., 1994; Segal, 1976; Prokop and Bajpai, 1991; Kuby, 1994; and Maniatis et al., 1982, each incorporated herein by reference, for that purpose.

As used herein, the term "oligonucleotide directed mutagenesis procedure" refers to template-dependent processes and vector-mediated propagation which result in an increase in the concentration of a specific nucleic acid molecule relative to its initial concentration, or in an increase in the concentration of a detectable signal, such as amplification. As used herein, the term "oligonucleotide directed mutagenesis procedure" is intended to refer to a process that involves the template-dependent extension of a primer molecule. The term template dependent process refers to nucleic acid synthesis of an RNA or a DNA molecule wherein the sequence of the newly synthesized strand of nucleic acid is dictated by the well-known rules of complementary base pairing (see, for example, Watson, 1987). Typically, vector mediated methodologies involve the introduction of the nucleic acid fragment into a DNA or RNA vector, the clonal amplification of the vector, and the recovery of the amplified nucleic acid fragment. Examples of such methodologies are provided by U.S. Pat. No. 4,237,224, specifically incorporated herein by reference in its entirety.

In another approach for the production of polypeptide variants of the present invention, recursive sequence recombination, as described in U.S. Pat. No. 5,837,458, may be employed. In this approach, iterative cycles of recombination and screening or selection are performed to "evolve" individual polynucleotide variants of the invention having, for example, enhanced immunogenic activity.

In other embodiments of the present invention, the polynucleotide sequences provided herein can be advantageously used as probes or primers for nucleic acid hybridization. As such, it is contemplated that nucleic acid segments that comprise a sequence region of at least about 15 nucleotide long contiguous sequence that has the same sequence as, or is complementary to, a 15 nucleotide long contiguous sequence disclosed herein will find particular utility. Longer contiguous identical or complementary sequences, e.g., those of about 20, 30, 40, 50, 100, 200, 500, 1000 (including all intermediate lengths) and even up to full length sequences will also be of use in certain embodiments.

The ability of such nucleic acid probes to specifically hybridize to a sequence of interest will enable them to be of use in detecting the presence of complementary sequences in a given sample. However, other uses are also envisioned, such as the use of the sequence information for the preparation of mutant species primers, or primers for use in preparing other genetic constructions.

Polynucleotide molecules having sequence regions consisting of contiguous nucleotide stretches of 10–14, 15–20, 30, 50, or even of 100–200 nucleotides or so (including intermediate lengths as well), identical or complementary to a polynucleotide sequence disclosed herein, are particularly contemplated as hybridization probes for use in, e.g., Southern and Northern blotting. This would allow a gene product, or fragment thereof, to be analyzed, both in diverse cell types and also in various bacterial cells. The total size of fragment, as well as the size of the complementary stretch (es), will ultimately depend on the intended use or application of the particular nucleic acid segment. Smaller fragments will generally find use in hybridization embodiments, wherein the length of the contiguous complementary region may be varied, such as between about 15 and about 100 nucleotides, but larger contiguous complementarity stretches may be used, according to the length complementary sequences one wishes to detect.

The use of a hybridization probe of about 15–25 nucleotides in length allows the formation of a duplex molecule that is both stable and selective. Molecules having contiguous complementary sequences over stretches greater than 15 bases in length are generally preferred, though, in order to increase stability and selectivity of the hybrid, and thereby improve the quality and degree of specific hybrid molecules obtained. One will generally prefer to design nucleic acid molecules having gene-complementary stretches of 15 to 25 contiguous nucleotides, or even longer where desired.

Hybridization probes may be selected from any portion of any of the sequences disclosed herein. All that is required is to review the sequences set forth herein, or to any continuous portion of the sequences, from about 15–25 nucleotides in length up to and including the full length sequence, that one wishes to utilize as a probe or primer. The choice of probe and primer sequences may be governed by various factors. For example, one may wish to employ primers from towards the termini of the total sequence.

Small polynucleotide segments or fragments may be readily prepared by, for example, directly synthesizing the fragment by chemical means, as is commonly practiced using an automated oligonucleotide synthesizer. Also, fragments may be obtained by application of nucleic acid reproduction technology, such as the PCR™ technology of U.S. Pat. No. 4,683,202 (incorporated herein by reference), by introducing selected sequences into recombinant vectors for recombinant production, and by other recombinant DNA techniques generally known to those of skill in the art of molecular biology.

The nucleotide sequences of the invention may be used for their ability to selectively form duplex molecules with complementary stretches of the entire gene or gene fragments of interest. Depending on the application envisioned, one will typically desire to employ varying conditions of hybridization to achieve varying degrees of selectivity of probe towards target sequence. For applications requiring high selectivity, one will typically desire to employ relatively stringent conditions to form the hybrids, e.g., one will select relatively low salt and/or high temperature conditions, such as provided by a salt concentration of from about 0.02 M to about 0.15 M salt at temperatures of from about 50° C. to about 70° C. Such selective conditions tolerate little, if any, mismatch between the probe and the template or target strand, and would be particularly suitable for isolating related sequences.

Of course, for some applications, for example, where one desires to prepare mutants employing a mutant primer strand hybridized to an underlying template, less stringent (reduced stringency) hybridization conditions will typically be needed in order to allow formation of the heteroduplex. In these circumstances, one may desire to employ salt conditions such as those of from about 0.15 M to about 0.9 M salt, at temperatures ranging from about 20° C. to about 55° C. Cross-hybridizing species can thereby be readily identified as positively hybridizing signals with respect to control hybridizations. In any case, it is generally appreciated that conditions can be rendered more stringent by the addition of increasing amounts of formamide, which serves to destabilize the hybrid duplex in the same manner as increased temperature. Thus, hybridization conditions can be readily manipulated, and thus will generally be a method of choice depending on the desired results.

According to another embodiment of the present invention, polynucleotide compositions comprising antisense oligonucleotides are provided. Antisense oligonucleotides have been demonstrated to be effective and targeted inhibitors of protein synthesis, and, consequently, provide a therapeutic approach by which a disease can be treated by inhibiting the synthesis of proteins that contribute to the disease. The efficacy of antisense oligonucleotides for inhibiting protein synthesis is well established. For example, the synthesis of polygalactauronase and the muscarine type 2 acetylcholine receptor are inhibited by antisense oligonucleotides directed to their respective mRNA sequences (U.S. Pat. No. 5,739,119 and U.S. Pat. No. 5,759,829). Further, examples of antisense inhibition have been demonstrated with the nuclear protein cyclin, the multiple drug resistance gene (MDG1), ICAM-1, E-selectin, STK-1, striatal $GABA_A$ receptor and human EGF (Jaskulski et al., Science. Jun. 10, 1988;240(4858):1544–6; Vasanthakumar and Ahmed, Cancer Commun. 1989;1(4):225–32; Peris et al., Brain Res Mol Brain Res. Jun. 15, 1998;57(2):310–20; U.S. Pat. No. 5,801,154; U.S. Pat. No. 5,789,573; U.S. Pat. No. 5,718,709 and U.S. Pat. No. 5,610,288). Antisense constructs have also been described that inhibit and can be used to treat a variety of abnormal cellular proliferations, e.g. cancer (U.S. Pat. No. 5,747,470; U.S. Pat. No. 5,591,317 and U.S. Pat. No. 5,783,683).

Therefore, in certain embodiments, the present invention provides oligonucleotide sequences that comprise all, or a portion of, any sequence that is capable of specifically binding to polynucleotide sequence described herein, or a complement thereof. In one embodiment, the antisense oligonucleotides comprise DNA or derivatives thereof. In another embodiment, the oligonucleotides comprise RNA or derivatives thereof. In a third embodiment, the oligonucleotides are modified DNAs comprising a phosphorothioated modified backbone. In a fourth embodiment, the oligonucleotide sequences comprise peptide nucleic acids or derivatives thereof. In each case, preferred compositions comprise a sequence region that is complementary, and more preferably substantially-complementary, and even more preferably, completely complementary to one or more portions of polynucleotides disclosed herein. Selection of antisense compositions specific for a given gene sequence is based upon analysis of the chosen target sequence and determination of secondary structure, $T_m$, binding energy, and relative stability. Antisense compositions may be selected based upon their relative inability to form dimers, hairpins, or other secondary structures that would reduce or prohibit specific binding to the target mRNA in a host cell. Highly preferred target regions of the mRNA, are those which are at or near the AUG translation initiation codon, and those sequences which are substantially complementary to 5' regions of the mRNA. These secondary structure analyses and target site selection considerations can be performed, for example, using v.4 of the OLIGO primer analysis software and/or the BLASTN 2.0.5 algorithm software (Altschul et al., Nucleic Acids Res. 1997, 25(17): 3389–402).

The use of an antisense delivery method employing a short peptide vector, termed MPG (27 residues), is also contemplated. The MPG peptide contains a hydrophobic domain derived from the fusion sequence of HIV gp41 and a hydrophilic domain from the nuclear localization sequence of SV40 T-antigen (Morris et al., Nucleic Acids Res. 1997 Jul 15;25(14):2730–6). It has been demonstrated that several molecules of the MPG peptide coat the antisense oligonucleotides and can be delivered into cultured mammalian cells in less than 1 hour with relatively high efficiency (90%). Further, the interaction with MPG strongly increases both the stability of the oligonucleotide to nuclease and the ability to cross the plasma membrane.

According to another embodiment of the invention, the polynucleotide compositions described herein are used in the design and preparation of ribozyme molecules for inhibiting expression of the tumor polypeptides and proteins of the present invention in tumor cells. Ribozymes are RNA-protein complexes that cleave nucleic acids in a site-specific fashion. Ribozymes have specific catalytic domains that possess endonuclease activity (Kim and Cech, Proc Natl Acad Sci USA. December 1987;84(24):8788–92; Forster and Symons, Cell. Apr. 24, 1987;49(2):211–20). For example, a large number of ribozymes accelerate phosphoester transfer reactions with a high degree of specificity, often cleaving only one of several phosphoesters in an oligonucleotide substrate (Cech et al., Cell. December 1981;27(3 Pt 2):487–96; Michel and Westhof, J Mol Biol. Dec. 5, 1990;216(3):585–610; Reinhold-Hurek and Shub, Nature. May 14, 1992;357(6374):173–6). This specificity has been attributed to the requirement that the substrate bind via specific base-pairing interactions to the internal guide sequence ("IGS") of the ribozyme prior to chemical reaction.

Six basic varieties of naturally occurring enzymatic RNAs are known presently. Each can catalyze the hydrolysis of RNA phosphodiester bonds in trans (and thus can cleave other RNA molecules) under physiological conditions. In general, enzymatic nucleic acids act by first binding to a target RNA. Such binding occurs through the target binding portion of a enzymatic nucleic acid which is held in close proximity to an enzymatic portion of the molecule that acts to cleave the target RNA. Thus, the enzymatic nucleic acid first recognizes and then binds a target RNA through complementary base-pairing, and once bound to the correct site, acts enzymatically to cut the target RNA. Strategic cleavage of such a target RNA will destroy its ability to direct synthesis of an encoded protein. After an enzymatic nucleic acid has bound and cleaved its RNA target, it is released from that RNA to search for another target and can repeatedly bind and cleave new targets.

The enzymatic nature of a ribozyme is advantageous over many technologies, such as antisense technology (where a nucleic acid molecule simply binds to a nucleic acid target to block its translation) since the concentration of ribozyme necessary to affect a therapeutic treatment is lower than that of an antisense oligonucleotide. This advantage reflects the ability of the ribozyme to act enzymatically. Thus, a single ribozyme molecule is able to cleave many molecules of target RNA. In addition, the ribozyme is a highly specific inhibitor, with the specificity of inhibition depending not only on the base pairing mechanism of binding to the target RNA, but also on the mechanism of target RNA cleavage. Single mismatches, or base-substitutions, near the site of cleavage can completely eliminate catalytic activity of a ribozyme. Similar mismatches in antisense molecules do not prevent their action (Woolf et al., Proc Natl Acad Sci USA. Aug. 15, 1992;89(16):7305–9). Thus, the specificity of action of a ribozyme is greater than that of an antisense oligonucleotide binding the same RNA site.

The enzymatic nucleic acid molecule may be formed in a hammerhead, hairpin, a hepatitis δ virus, group I intron or RNaseP RNA (in association with an RNA guide sequence) or Neurospora VS RNA motif. Examples of hammerhead motifs are described by Rossi et al. Nucleic Acids Res. Sep. 11, 1992;20(17):4559–65. Examples of hairpin motifs are described by Hampel et al. (Eur. Pat. Appl. Publ. No. EP 0360257), Hampel and Tritz, Biochemistry Jun. 13, 1989;28 (12):4929–33; Hampel et al., Nucleic Acids Res. Jan. 25, 1990;18(2):299–304 and U.S. Pat. No. 5,631,359. An example of the hepatitis δ virus motif is described by Perrotta and Been, Biochemistry. Dec. 1, 1992;31(47): 11843–52; an example of the RNaseP motif is described by Guerrier-Takada et al., Cell. December 1983;35(3 Pt 2):849–57; Neurospora VS RNA ribozyme motif is described by Collins (Saville and Collins, Cell. May 18, 1990;61(4):685–96; Saville and Collins, Proc Natl Acad Sci USA. Oct. 1, 1991;88(19):8826–30; Collins and Olive, Biochemistry. Mar. 23, 1993;32(11):2795–9); and an example of the Group I intron is described in (U.S. Pat. No. 4,987,071). All that is important in an enzymatic nucleic acid molecule of this invention is that it has a specific substrate binding site which is complementary to one or more of the target gene RNA regions, and that it have nucleotide sequences within or surrounding that substrate binding site which impart an RNA cleaving activity to the molecule. Thus the ribozyme constructs need not be limited to specific motifs mentioned herein.

Ribozymes may be designed as described in Int. Pat. Appl. Publ. No. WO 93/23569 and Int. Pat. Appl. Publ. No. WO 94/02595, each specifically incorporated herein by reference) and synthesized to be tested in vitro and in vivo, as described. Such ribozymes can also be optimized for delivery. While specific examples are provided, those in the art will recognize that equivalent RNA targets in other species can be utilized when necessary.

Ribozyme activity can be optimized by altering the length of the ribozyme binding arms, or chemically synthesizing ribozymes with modifications that prevent their degradation by serum ribonucleases (see e.g., Int. Pat. Appl. Publ. No. WO 92/07065; Int. Pat. Appl. Publ. No. WO 93/15187; Int. Pat. Appl. Publ. No. WO 91/03162; Eur. Pat. Appl. Publ. No. 92110298.4; U.S. Pat. No. 5,334,711; and Int. Pat. Appl. Publ. No. WO 94/13688, which describe various chemical modifications that can be made to the sugar moieties of enzymatic RNA molecules), modifications which enhance their efficacy in cells, and removal of stem II bases to shorten RNA synthesis times and reduce chemical requirements.

Sullivan et al. (Int. Pat. Appl. Publ. No. WO 94/02595) describes the general methods for delivery of enzymatic RNA molecules. Ribozymes may be administered to cells by a variety of methods known to those familiar to the art, including, but not restricted to, encapsulation in liposomes, by iontophoresis, or by incorporation into other vehicles, such as hydrogels, cyclodextrins, biodegradable nanocapsules, and bioadhesive microspheres. For some indications, ribozymes may be directly delivered ex vivo to cells or tissues with or without the aforementioned vehicles. Alternatively, the RNA/vehicle combination may be locally delivered by direct inhalation, by direct injection or by use of a catheter, infusion pump or stent. Other routes of delivery include, but are not limited to, intravascular, intramuscular, subcutaneous or joint injection, aerosol inhalation, oral (tablet or pill form), topical, systemic, ocular, intraperitoneal and/or intrathecal delivery. More detailed descriptions of ribozyme delivery and administration are provided in Int. Pat. Appl. Publ. No. WO 94/02595 and Int. Pat. Appl. Publ. No. WO 93/23569, each specifically incorporated herein by reference.

Another means of accumulating high concentrations of a ribozyme(s) within cells is to incorporate the ribozyme-encoding sequences into a DNA expression vector. Transcription of the ribozyme sequences are driven from a promoter for eukaryotic RNA polymerase I (pol I), RNA polymerase II (pol II), or RNA polymerase III (pol III). Transcripts from pol II or pol III promoters will be expressed at high levels in all cells; the levels of a given pol II promoter in a given cell type will depend on the nature of the gene regulatory sequences (enhancers, silencers, etc.) present nearby. Prokaryotic RNA polymerase promoters may also be used, providing that the prokaryotic RNA polymerase enzyme is expressed in the appropriate cells. Ribozymes expressed from such promoters have been shown to function in mammalian cells. Such transcription units can be incorporated into a variety of vectors for introduction into mammalian cells, including but not restricted to, plasmid DNA vectors, viral DNA vectors (such as adenovirus or adeno-associated vectors), or viral RNA vectors (such as retroviral, semliki forest virus, sindbis virus vectors).

In another embodiment of the invention, peptide nucleic acids (PNAs) compositions are provided. PNA is a DNA mimic in which the nucleobases are attached to a pseudopeptide backbone (Good and Nielsen, Antisense Nucleic Acid Drug Dev. 1997 7(4) 431–37). PNA is able to be utilized in a number methods that traditionally have used RNA or DNA. Often PNA sequences perform better in techniques than the corresponding RNA or DNA sequences and have utilities that are not inherent to RNA or DNA. A review of PNA including methods of making, characteristics of, and methods of using, is provided by Corey (*Trends Biotechnol June* 1997;15(6):224–9). As such, in certain embodiments, one may prepare PNA sequences that are complementary to one or more portions of the ACE mRNA sequence, and such PNA compositions may be used to regulate, alter, decrease, or reduce the translation of ACE-specific mRNA, and thereby alter the level of ACE activity in a host cell to which such PNA compositions have been administered.

PNAs have 2-aminoethyl-glycine linkages replacing the normal phosphodiester backbone of DNA (Nielsen et al., *Science* Dec. 6, 1991;254(5037):1497–500; Hanvey et al., Science. Nov. 27, 1992;258(5087):1481–5; Hyrup and Nielsen, Bioorg Med Chem. January 1996;4(1):5–23). This chemistry has three important consequences: firstly, in contrast to DNA or phosphorothioate oligonucleotides, PNAs are neutral molecules; secondly, PNAs are achiral, which avoids the need to develop a stereoselective synthesis; and thirdly, PNA synthesis uses standard Boc or Fmoc protocols for solid-phase peptide synthesis, although other methods, including a modified Merrifield method, have been used.

PNA monomers or ready-made oligomers are commercially available from PerSeptive Biosystems (Framingham, Mass.). PNA syntheses by either Boc or Fmoc protocols are straightforward using manual or automated protocols (Norton et al., Bioorg Med Chem. April 1995;3(4):437–45). The manual protocol lends itself to the production of chemically modified PNAs or the simultaneous synthesis of families of closely related PNAs.

As with peptide synthesis, the success of a particular PNA synthesis will depend on the properties of the chosen sequence. For example, while in theory PNAs can incorporate any combination of nucleotide bases, the presence of adjacent purines can lead to deletions of one or more residues in the product. In expectation of this difficulty, it is suggested that, in producing PNAs with adjacent purines, one should repeat the coupling of residues likely to be added inefficiently. This should be followed by the purification of PNAs by reverse-phase high-pressure liquid chromatography, providing yields and purity of product similar to those observed during the synthesis of peptides.

Modifications of PNAs for a given application may be accomplished by coupling amino acids during solid-phase synthesis or by attaching compounds that contain a carboxylic acid group to the exposed N-terminal amine. Alternatively, PNAs can be modified after synthesis by coupling to an introduced lysine or cysteine. The ease with which PNAs can be modified facilitates optimization for better solubility or for specific functional requirements. Once synthesized, the identity of PNAs and their derivatives can be confirmed by mass spectrometry. Several studies have made and utilized modifications of PNAs (for example, Norton et al., Bioorg Med Chem. April 1995;3(4):437–45; Petersen et al., J Pept Sci. May–June 1995;1(3):175–83; Orum et al., Biotechniques. September 1995;19(3):472–80; Footer et al., Biochemistry. Aug. 20, 1996;35(33):10673–9; Griffith et al., Nucleic Acids Res. Aug. 11, 1995;23(15): 3003–8; Pardridge et al., Proc Natl Acad Sci USA. Jun. 6, 1995;92(12):5592–6; Boffa et al., Proc Natl Acad Sci USA. Mar. 14, 1995;92(6):1901–5; Gambacorti-Passerini et al., Blood. Aug. 15, 1996;88(4):1411–7; Armitage et al., Proc Natl Acad Sci USA. Nov. 11, 1997;94(23):12320–5; Seeger et al., Biotechniques. September 1997;23(3):512–7). U.S. Pat. No. 5,700,922 discusses PNA-DNA-PNA chimeric molecules and their uses in diagnostics, modulating protein in organisms, and treatment of conditions susceptible to therapeutics.

Methods of characterizing the antisense binding properties of PNAs are discussed in Rose (Anal Chem. Dec. 15, 1993;65(24):3545–9) and Jensen et al. (Biochemistry. Apr. 22, 1997;36(16):5072–7). Rose uses capillary gel electrophoresis to determine binding of PNAs to their complementary oligonucleotide, measuring the relative binding kinetics and stoichiometry. Similar types of measurements were made by Jensen et al. using BIAcore™ technology.

Other applications of PNAs that have been described and will be apparent to the skilled artisan include use in DNA strand invasion, antisense inhibition, mutational analysis, enhancers of transcription, nucleic acid purification, isolation of transcriptionally active genes, blocking of transcription factor binding, genome cleavage, biosensors, in situ hybridization, and the like.

Polynucleotide Identification, Characterization and Expression

Polynucleotides compositions of the present invention may be identified, prepared and/or manipulated using any of a variety of well established techniques (see generally, Sambrook et al., *Molecular Cloning: A Laboratory Manual*, Cold Spring Harbor Laboratories, Cold Spring Harbor, N.Y., 1989, and other like references). For example, a polynucleotide may be identified, as described in more detail below, by screening a microarray of cDNAs for tumor-associated expression (i.e., expression that is at least two fold greater in a tumor than in normal tissue, as determined using a representative assay provided herein). Such screens may be performed, for example, using the microarray technology of Affymetrix, Inc. (Santa Clara, Calif.) according to the manufacturer's instructions (and essentially as described by Schena et al., *Proc. Natl. Acad. Sci. USA* 93:10614–10619, 1996 and Heller et al., *Proc. Natl. Acad. Sci. USA* 94:2150–2155, 1997). Alternatively, polynucleotides may be amplified from cDNA prepared from cells expressing the proteins described herein, such as tumor cells.

Many template dependent processes are available to amplify a target sequences of interest present in a sample. One of the best known amplification methods is the polymerase chain reaction (PCR™) which is described in detail in U.S. Pat. Nos. 4,683,195, 4,683,202 and 4,800,159, each of which is incorporated herein by reference in its entirety. Briefly, in PCR™, two primer sequences are prepared which are complementary to regions on opposite complementary strands of the target sequence. An excess of deoxynucleoside triphosphates is added to a reaction mixture along with a DNA polymerase (e.g., Taq polymerase). If the target sequence is present in a sample, the primers will bind to the target and the polymerase will cause the primers to be extended along the target sequence by adding on nucleotides. By raising and lowering the temperature of the reaction mixture, the extended primers will dissociate from the target to form reaction products, excess primers will bind to the target and to the reaction product and the process is repeated. Preferably reverse transcription and PCR™ amplification procedure may be performed in order to quantify the amount of mRNA amplified. Polymerase chain reaction methodologies are well known in the art.

Any of a number of other template dependent processes, many of which are variations of the PCR ™ amplification technique, are readily known and available in the art. Illustratively, some such methods include the ligase chain reaction (referred to as LCR), described, for example, in Eur. Pat. Appl. Publ. No. 320,308 and U.S. Pat. No. 4,883,750; Qbeta Replicase, described in PCT Intl. Pat. Appl. Publ. No. PCT/US87/00880; Strand Displacement Amplification (SDA) and Repair Chain Reaction (RCR). Still other amplification methods are described in Great Britain Pat. Appl. No. 2 202 328, and in PCT Intl. Pat. Appl. Publ. No. PCT/US89/01025. Other nucleic acid amplification procedures include transcription-based amplification systems (TAS) (PCT Intl. Pat. Appl. Publ. No. WO 88/10315), including nucleic acid sequence based amplification (NASBA) and 3SR. Eur. Pat. Appl. Publ. No. 329,822 describes a nucleic acid amplification process involving cyclically synthesizing single-stranded RNA ("ssRNA"), ssDNA, and double-stranded DNA (dsDNA). PCT Intl. Pat. Appl. Publ. No. WO 89/06700 describes a nucleic acid sequence amplification scheme based on the hybridization of a promoter/primer sequence to a target single-stranded DNA ("ssDNA") followed by transcription of many RNA copies of the sequence. Other amplification methods such as "RACE" (Frohman, 1990), and "one-sided PCR" (Ohara, 1989) are also well-known to those of skill in the art.

An amplified portion of a polynucleotide of the present invention may be used to isolate a full length gene from a suitable library (e.g., a tumor cDNA library) using well known techniques. Within such techniques, a library (cDNA or genomic) is screened using one or more polynucleotide probes or primers suitable for amplification. Preferably, a library is size-selected to include larger molecules. Random primed libraries may also be preferred for identifying 5' and upstream regions of genes. Genomic libraries are preferred for obtaining introns and extending 5' sequences.

For hybridization techniques, a partial sequence may be labeled (e.g., by nick-translation or end-labeling with $^{32}P$) using well-known techniques. A bacterial or bacteriophage library is then generally screened by hybridizing filters containing denatured bacterial colonies (or lawns containing phage plaques) with the labeled probe (see Sambrook et al., *Molecular Cloning: A Laboratory Manual*, Cold Spring Harbor Laboratories, Cold Spring Harbor, N.Y., 1989). Hybridizing colonies or plaques are selected and expanded, and the DNA is isolated for further analysis. cDNA clones may be analyzed to determine the amount of additional sequence by, for example, PCR using a primer from the partial sequence and a primer from the vector. Restriction maps and partial sequences may be generated to identify one or more overlapping clones. The complete sequence may then be determined using standard techniques, which may involve generating a series of deletion clones. The resulting overlapping sequences can then assembled into a single contiguous sequence. A full length cDNA molecule can be generated by ligating suitable fragments, using well known techniques.

Alternatively, amplification techniques, such as those described above, can be useful for obtaining a full length coding sequence from a partial cDNA sequence. One such amplification technique is inverse PCR (see Triglia et al., *Nucl. Acids Res.* 16:8186, 1988), which uses restriction enzymes to generate a fragment in the known region of the gene. The fragment is then circularized by intramolecular ligation and used as a template for PCR with divergent primers derived from the known region. Within an alternative approach, sequences adjacent to a partial sequence may be retrieved by amplification with a primer to a linker sequence and a primer specific to a known region. The amplified sequences are typically subjected to a second round of amplification with the same linker primer and a second primer specific to the known region. A variation on this procedure, which employs two primers that initiate extension in opposite directions from the known sequence, is described in WO 96/38591. Another such technique is known as "rapid amplification of cDNA ends" or RACE. This technique involves the use of an internal primer and an external primer, which hybridizes to a polyA region or vector sequence, to identify sequences that are 5' and 3' of a known sequence. Additional techniques include capture PCR (Lagerstrom et al., *PCR Methods Applic.* 1:111–19, 1991) and walking PCR (Parker et al., *Nucl. Acids. Res.* 19:3055–60, 1991). Other methods employing amplification may also be employed to obtain a full length cDNA sequence.

In certain instances, it is possible to obtain a full length cDNA sequence by analysis of sequences provided in an expressed sequence tag (EST) database, such as that available from GenBank. Searches for overlapping ESTs may generally be performed using well known programs (e.g., NCBI BLAST searches), and such ESTs may be used to generate a contiguous full length sequence. Full length DNA sequences may also be obtained by analysis of genomic fragments.

In other embodiments of the invention, polynucleotide sequences or fragments thereof which encode polypeptides of the invention, or fusion proteins or functional equivalents thereof, may be used in recombinant DNA molecules to direct expression of a polypeptide in appropriate host cells. Due to the inherent degeneracy of the genetic code, other DNA sequences that encode substantially the same or a functionally equivalent amino acid sequence may be produced and these sequences may be used to clone and express a given polypeptide.

As will be understood by those of skill in the art, it may be advantageous in some instances to produce polypeptide-encoding nucleotide sequences possessing non-naturally occurring codons. For example, codons preferred by a particular prokaryotic or eukaryotic host can be selected to increase the rate of protein expression or to produce a recombinant RNA transcript having desirable properties, such as a half-life which is longer than that of a transcript generated from the naturally occurring sequence.

Moreover, the polynucleotide sequences of the present invention can be engineered using methods generally known in the art in order to alter polypeptide encoding sequences for a variety of reasons, including but not limited to, alterations which modify the cloning, processing, and/or expression of the gene product. For example, DNA shuffling by random fragmentation and PCR reassembly of gene fragments and synthetic oligonucleotides may be used to engineer the nucleotide sequences. In addition, site-directed mutagenesis may be used to insert new restriction sites, alter glycosylation patterns, change codon preference, produce splice variants, or introduce mutations, and so forth.

In another embodiment of the invention, natural, modified, or recombinant nucleic acid sequences may be ligated to a heterologous sequence to encode a fusion protein. For example, to screen peptide libraries for inhibitors of polypeptide activity, it may be useful to encode a chimeric protein that can be recognized by a commercially available antibody. A fusion protein may also be engineered to contain a cleavage site located between the polypeptide-encoding sequence and the heterologous protein sequence, so that the polypeptide may be cleaved and purified away from the heterologous moiety.

Sequences encoding a desired polypeptide may be synthesized, in whole or in part, using chemical methods well known in the art (see Caruthers, M. H. et al. (1980) *Nucl. Acids Res. Symp. Ser.* 215–223, Horn, T. et al. (1980) *Nucl. Acids Res. Symp. Ser.* 225–232). Alternatively, the protein itself may be produced using chemical methods to synthesize the amino acid sequence of a polypeptide, or a portion thereof. For example, peptide synthesis can be performed using various solid-phase techniques (Roberge, J. Y. et al. (1995) *Science* 269:202–204) and automated synthesis may be achieved, for example, using the ABI 431 A Peptide Synthesizer (Perkin Elmer, Palo Alto, Calif.).

A newly synthesized peptide may be substantially purified by preparative high performance liquid chromatography (e.g., Creighton, T. (1983) Proteins, Structures and Molecular Principles, W H Freeman and Co., New York, N.Y.) or other comparable techniques available in the art. The composition of the synthetic peptides may be confirmed by amino acid analysis or sequencing (e.g., the Edman degradation procedure). Additionally, the amino acid sequence of a polypeptide, or any part thereof, may be altered during direct synthesis and/or combined using chemical methods with sequences from other proteins, or any part thereof, to produce a variant polypeptide.

In order to express a desired polypeptide, the nucleotide sequences encoding the polypeptide, or functional equivalents, may be inserted into appropriate expression vector, i.e., a vector which contains the necessary elements for the transcription and translation of the inserted coding sequence. Methods which are well known to those skilled in the art may be used to construct expression vectors containing sequences encoding a polypeptide of interest and appropriate transcriptional and translational control elements. These methods include in vitro recombinant DNA techniques, synthetic techniques, and in vivo genetic recombination. Such techniques are described, for example, in Sambrook, J. et al. (1989) Molecular Cloning, A Laboratory Manual, Cold Spring Harbor Press, Plainview, N.Y., and Ausubel, F. M. et al. (1989) Current Protocols in Molecular Biology, John Wiley & Sons, New York. N.Y.

A variety of expression vector/host systems may be utilized to contain and express polynucleotide sequences. These include, but are not limited to, microorganisms such as bacteria transformed with recombinant bacteriophage, plasmid, or cosmid DNA expression vectors; yeast transformed with yeast expression vectors; insect cell systems infected with virus expression vectors (e.g., baculovirus); plant cell systems transformed with virus expression vectors (e.g., cauliflower mosaic virus, CaMV; tobacco mosaic virus, TMV) or with bacterial expression vectors (e.g., Ti or pBR322 plasmids); or animal cell systems.

The "control elements" or "regulatory sequences" present in an expression vector are those non-translated regions of the vector—enhancers, promoters, 5' and 3' untranslated regions—which interact with host cellular proteins to carry out transcription and translation. Such elements may vary in their strength and specificity. Depending on the vector system and host utilized, any number of suitable transcription and translation elements, including constitutive and inducible promoters, may be used. For example, when cloning in bacterial systems, inducible promoters such as the hybrid lacZ promoter of the PBLUESCRIPT phagemid (Stratagene, La Jolla, Calif.) or PSPORT1 plasmid (Gibco BRL, Gaithersburg, Md.) and the like may be used. In mammalian cell systems, promoters from mammalian genes or from mammalian viruses are generally preferred. If it is necessary to generate a cell line that contains multiple copies of the sequence encoding a polypeptide, vectors based on SV40 or EBV may be advantageously used with an appropriate selectable marker.

In bacterial systems, any of a number of expression vectors may be selected depending upon the use intended for the expressed polypeptide. For example, when large quantities are needed, for example for the induction of antibodies, vectors which direct high level expression of fusion proteins that are readily purified may be used. Such vectors include, but are not limited to, the multifunctional *E. coli* cloning and expression vectors such as BLUESCRIPT (Stratagene), in which the sequence encoding the polypeptide of interest may be ligated into the vector in frame with sequences for the amino-terminal Met and the subsequent 7 residues of .beta.-galactosidase so that a hybrid protein is produced; pIN vectors (Van Heeke, G. and S. M. Schuster (1989) *J. Biol. Chem.* 264:5503–5509); and the like. pGEX Vectors (Promega, Madison, Wis.) may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems may be designed to include heparin, thrombin, or factor XA protease cleavage sites so that the cloned polypeptide of interest can be released from the GST moiety at will.

In the yeast, *Saccharomyces cerevisiae*, a number of vectors containing constitutive or inducible promoters such as alpha factor, alcohol oxidase, and PGH may be used. For reviews, see Ausubel et al. (supra) and Grant et al. (1987) *Methods Enzymol.* 153:516–544.

In cases where plant expression vectors are used, the expression of sequences encoding polypeptides may be driven by any of a number of promoters. For example, viral promoters such as the 35S and 19S promoters of CaMV may be used alone or in combination with the omega leader sequence from TMV (Takamatsu, N. (1987) *EMBO J.* 6:307–311. Alternatively, plant promoters such as the small subunit of RUBISCO or heat shock promoters may be used (Coruzzi, G. et al. (1984) *EMBO J* 3:1671–1680; Broglie, R. et al. (1984) *Science* 224:838–843; and Winter, J. et al. (1991) *Results Probl. Cell Differ.* 17:85–105). These constructs can be introduced into plant cells by direct DNA transformation or pathogen-mediated transfection. Such techniques are described in a number of generally available reviews (see, for example, Hobbs, S. or Murry, L. E. in McGraw Hill Yearbook of Science and Technology (1992) McGraw Hill, New York, N.Y.; pp. 191–196).

An insect system may also be used to express a polypeptide of interest. For example, in one such system, Autographa californica nuclear polyhedrosis virus (AcNPV) is used as a vector to express foreign genes in *Spodoptera frugiperda* cells or in Trichoplusia larvae. The sequences encoding the polypeptide may be cloned into a non-essential region of the virus, such as the polyhedrin gene, and placed under control of the polyhedrin promoter. Successful insertion of the polypeptide-encoding sequence will render the polyhedrin gene inactive and produce recombinant virus lacking coat protein. The recombinant viruses may then be used to infect, for example, *S. frugiperda* cells or Trichoplusia larvae in which the polypeptide of interest may be expressed (Engelhard, E. K. et al. (1994) *Proc. Natl. Acad. Sci.* 91:3224–3227).

In mammalian host cells, a number of viral-based expression systems are generally available. For example, in cases where an adenovirus is used as an expression vector, sequences encoding a polypeptide of interest may be ligated into an adenovirus transcription/translation complex consisting of the late promoter and tripartite leader sequence. Insertion in a non-essential E1 or E3 region of the viral genome may be used to obtain a viable virus which is capable of expressing the polypeptide in infected host cells (Logan, J. and Shenk, T. (1984) *Proc. Natl. Acad. Sci.* 81:3655–3659). In addition, transcription enhancers, such as the Rous sarcoma virus (RSV) enhancer, may be used to increase expression in mammalian host cells.

Specific initiation signals may also be used to achieve more efficient translation of sequences encoding a polypeptide of interest. Such signals include the ATG initiation codon and adjacent sequences. In cases where sequences encoding the polypeptide, its initiation codon, and upstream sequences are inserted into the appropriate expression vector, no additional transcriptional or translational control signals may be needed. However, in cases where only coding sequence, or a portion thereof, is inserted, exogenous translational control signals including the ATG initiation codon should be provided. Furthermore, the initiation codon should be in the correct reading frame to ensure translation of the entire insert. Exogenous translational elements and initiation codons may be of various origins, both natural and synthetic. The efficiency of expression may be enhanced by the inclusion of enhancers which are appropriate for the particular cell system which is used, such as those described in the literature (Scharf, D. et al. (1994) *Results Probl. Cell Differ.* 20:125–162).

In addition, a host cell strain may be chosen for its ability to modulate the expression of the inserted sequences or to process the expressed protein in the desired fashion. Such modifications of the polypeptide include, but are not limited to, acetylation, carboxylation. glycosylation, phosphorylation, lipidation, and acylation. Post-translational processing which cleaves a "prepro" form of the protein may also be used to facilitate correct insertion, folding and/or function. Different host cells such as CHO, COS, HeLa, MDCK, HEK293, and W138, which have specific cellular machinery and characteristic mechanisms for such post-translational activities, may be chosen to ensure the correct modification and processing of the foreign protein.

For long-term, high-yield production of recombinant proteins, stable expression is generally preferred. For example, cell lines which stably express a polynucleotide of interest may be transformed using expression vectors which may contain viral origins of replication and/or endogenous expression elements and a selectable marker gene on the same or on a separate vector. Following the introduction of the vector, cells may be allowed to grow for 1–2 days in an enriched media before they are switched to selective media. The purpose of the selectable marker is to confer resistance to selection, and its presence allows growth and recovery of cells which successfully express the introduced sequences. Resistant clones of stably transformed cells may be proliferated using tissue culture techniques appropriate to the cell type.

Any number of selection systems may be used to recover transformed cell lines. These include, but are not limited to, the herpes simplex virus thymidine kinase (Wigler, M. et al. (1977) *Cell* 11:223–32) and adenine phosphoribosyltransferase (Lowy, I. et al. (1990) *Cell* 22:817–23) genes which can be employed in tk.sup.—or aprt.sup.—cells, respectively. Also, antimetabolite, antibiotic or herbicide resistance can be used as the basis for selection; for example, dhfr which confers resistance to methotrexate (Wigler, M. et al. (1980) *Proc. Natl. Acad. Sci.* 77:3567–70); npt, which confers resistance to the aminoglycosides, neomycin and G-418 (Colbere-Garapin, F. et al (1981) *J. Mol. Biol* 150:1–14); and als or pat, which confer resistance to chlorsulfuron and phosphinotricin acetyltransferase, respectively (Murry, supra). Additional selectable genes have been described, for example, trpB, which allows cells to utilize indole in place of tryptophan, or hisD, which allows cells to utilize histinol in place of histidine (Hartman, S. C. and R. C. Mulligan (1988) *Proc. Natl. Acad. Sci.* 85:8047–51). The use of visible markers has gained popularity with such markers as anthocyanins, beta-glucuronidase and its substrate GUS, and luciferase and its substrate luciferin, being widely used not only to identify transformants, but also to quantify the amount of transient or stable protein expression attributable to a specific vector system (Rhodes, C. A. et al. (1995) *Methods Mol. Biol.* 55:121–131).

Although the presence/absence of marker gene expression suggests that the gene of interest is also present, its presence and expression may need to be confirmed. For example, if the sequence encoding a polypeptide is inserted within a marker gene sequence, recombinant cells containing sequences can be identified by the absence of marker gene function. Alternatively, a marker gene can be placed in tandem with a polypeptide-encoding sequence under the control of a single promoter. Expression of the marker gene in response to induction or selection usually indicates expression of the tandem gene as well.

Alternatively, host cells that contain and express a desired polynucleotide sequence may be identified by a variety of procedures known to those of skill in the art. These procedures include, but are not limited to, DNA-DNA or DNA-RNA hybridizations and protein bioassay or immunoassay techniques which include, for example, membrane, solution, or chip based technologies for the detection and/or quantification of nucleic acid or protein.

A variety of protocols for detecting and measuring the expression of polynucleotide-encoded products, using either polyclonal or monoclonal antibodies specific for the product are known in the art. Examples include enzyme-linked immunosorbent assay (ELISA), radioimmunoassay (RIA), and fluorescence activated cell sorting (FACS). A two-site, monoclonal-based immunoassay utilizing monoclonal antibodies reactive to two non-interfering epitopes on a given polypeptide may be preferred for some applications, but a competitive binding assay may also be employed. These and other assays are described, among other places, in Hampton, R. et al. (1990; Serological Methods, a Laboratory Manual, APS Press, St Paul, Minn.) and Maddox, D. E. et al. (1983; *J. Exp. Med.* 158:1211–1216).

A wide variety of labels and conjugation techniques are known by those skilled in the art and may be used in various nucleic acid and amino acid assays. Means for producing labeled hybridization or PCR probes for detecting sequences related to polynucleotides include oligolabeling, nick translation, end-labeling or PCR amplification using a labeled nucleotide. Alternatively, the sequences, or any portions thereof may be cloned into a vector for the production of an mRNA probe. Such vectors are known in the art, are commercially available, and may be used to synthesize RNA probes in vitro by addition of an appropriate RNA polymerase such as T7, T3, or SP6 and labeled nucleotides. These procedures may be conducted using a variety of commercially available kits. Suitable reporter molecules or labels, which may be used include radionuclides, enzymes, fluorescent, chemiluminescent, or chromogenic agents as well as substrates, cofactors, inhibitors, magnetic particles, and the like.

Host cells transformed with a polynucleotide sequence of interest may be cultured under conditions suitable for the expression and recovery of the protein from cell culture. The protein produced by a recombinant cell may be secreted or contained intracellularly depending on the sequence and/or the vector used. As will be understood by those of skill in the art, expression vectors containing polynucleotides of the invention may be designed to contain signal sequences which direct secretion of the encoded polypeptide through a prokaryotic or eukaryotic cell membrane. Other recombinant constructions may be used to join sequences encoding a polypeptide of interest to nucleotide sequence encoding a polypeptide domain which will facilitate purification of soluble proteins. Such purification facilitating domains include, but are not limited to, metal chelating peptides such as histidine-tryptophan modules that allow purification on immobilized metals, protein A domains that allow purification on immobilized immunoglobulin, and the domain utilized in the FLAGS extension/affinity purification system (Immunex Corp., Seattle, Wash.). The inclusion of cleavable linker sequences such as those specific for Factor XA or enterokinase (Invitrogen, San Diego, Calif.) between the purification domain and the encoded polypeptide may be used to facilitate purification. One such expression vector provides for expression of a fusion protein containing a polypeptide of interest and a nucleic acid encoding 6 histidine residues preceding a thioredoxin or an enterokinase cleavage site. The histidine residues facilitate purification on IMIAC (immobilized metal ion affinity chromatography) as described in Porath, J. et al. (1992, *Prot. Exp. Purif* 3:263–281) while the enterokinase cleavage site provides a means for purifying the desired polypeptide from the fusion protein. A discussion of vectors which contain fusion proteins is provided in Kroll, D. J. et al. (1993; *DNA Cell Biol.* 12:441–453).

In addition to recombinant production methods, polypeptides of the invention, and fragments thereof, may be produced by direct peptide synthesis using solid-phase techniques (Merrifield J. (1963) *J. Am. Chem. Soc.* 85:2149–2154). Protein synthesis may be performed using manual techniques or by automation. Automated synthesis may be achieved, for example, using Applied Biosystems 431A Peptide Synthesizer (Perkin Elmer). Alternatively, various fragments may be chemically synthesized separately and combined using chemical methods to produce the full length molecule.

Antibody Compositions, Fragments Thereof and Other Binding Agents

According to another aspect, the present invention further provides binding agents, such as antibodies and antigen-binding fragments thereof, that exhibit immunological binding to a tumor polypeptide disclosed herein, or to a portion, variant or derivative thereof. An antibody, or antigen-binding fragment thereof, is said to "specifically bind," "immunogically bind," and/or is "immunologically reactive" to a polypeptide of the invention if it reacts at a detectable level (within, for example, an ELISA assay) with the polypeptide, and does not react detectably with unrelated polypeptides under similar conditions.

Immunological binding, as used in this context, generally refers to the non-covalent interactions of the type which occur between an immunoglobulin molecule and an antigen for which the immunoglobulin is specific. The strength, or affinity of immunological binding interactions can be expressed in terms of the dissociation constant ($K_d$) of the interaction, wherein a smaller $K_d$ represents a greater affinity. Immunological binding properties of selected polypeptides can be quantified using methods well known in the art. One such method entails measuring the rates of antigen-binding site/antigen complex formation and dissociation, wherein those rates depend on the concentrations of the complex partners, the affinity of the interaction, and on geometric parameters that equally influence the rate in both directions. Thus, both the "on rate constant" ($K_{on}$) and the "off rate constant" ($K_{off}$) can be determined by calculation of the concentrations and the actual rates of association and dissociation. The ratio of $K_{off}/K_{on}$ enables cancellation of all parameters not related to affinity, and is thus equal to the dissociation constant $K_d$. See, generally, Davies et al. (1990) Annual Rev. Biochem. 59:439–473.

An "antigen-binding site," or "binding portion" of an antibody refers to the part of the immunoglobulin molecule that participates in antigen binding. The antigen binding site is formed by amino acid residues of the N-terminal variable ("V") regions of the heavy ("H") and light ("L") chains. Three highly divergent stretches within the V regions of the heavy and light chains are referred to as "hypervariable regions" which are interposed between more conserved flanking stretches known as "framework regions," or "FRs". Thus the term "FR" refers to amino acid sequences which are naturally found between and adjacent to hypervariable regions in immunoglobulins. In an antibody molecule, the three hypervariable regions of a light chain and the three hypervariable regions of a heavy chain are disposed relative to each other in three dimensional space to form an antigen-binding surface. The antigen-binding surface is complementary to the three-dimensional surface of a bound antigen, and the three hypervariable regions of each of the heavy and light chains are referred to as "complementarity-determining regions," or "CDRs."

Binding agents may be further capable of differentiating between patients with and without a cancer, such as lung cancer, using the representative assays provided herein. For example, antibodies or other binding agents that bind to a tumor protein will preferably generate a signal indicating the presence of a cancer in at least about 20% of patients with the disease, more preferably at least about 30% of patients. Alternatively, or in addition, the antibody will generate a negative signal indicating the absence of the disease in at least about 90% of individuals without the cancer. To determine whether a binding agent satisfies this requirement, biological samples (e.g. blood, sera, sputum, urine and/or tumor biopsies) from patients with and without a cancer (as determined using standard clinical tests) may be assayed as described herein for the presence of polypeptides that bind to the binding agent. Preferably, a statistically significant number of samples with and without the disease will be assayed. Each binding agent should satisfy the above criteria; however, those of ordinary skill in the art will recognize that binding agents may be used in combination to improve sensitivity.

Any agent that satisfies the above requirements may be a binding agent. For example, a binding agent may be a ribosome, with or without a peptide component, an RNA molecule or a polypeptide. In a preferred embodiment, a binding agent is an antibody or an antigen-binding fragment thereof. Antibodies may be prepared by any of a variety of techniques known to those of ordinary skill in the art. See, e.g., Harlow and Lane, *Antibodies: A Laboratory Manual*, Cold Spring Harbor Laboratory, 1988. In general, antibodies can be produced by cell culture techniques, including the generation of mono clonal antibodies as described herein, or via transfection of antibody genes into suitable bacterial or mammalian cell hosts, in order to allow for the production of recombinant antibodies. In one technique, an immunogen comprising the polypeptide is initially injected into any of a wide variety of mammals (e.g., mice, rats, rabbits, sheep or goats). In this step, the polypeptides of this invention may serve as the immunogen without modification. Alternatively, particularly for relatively short polypeptides, a superior immune response may be elicited if the polypeptide is joined to a carrier protein, such as bovine serum albumin or keyhole limpet hemocyanin. The immunogen is injected into the animal host, preferably according to a predetermined schedule incorporating one or more booster immunizations, and the animals are bled periodically. Polyclonal antibodies specific for the polypeptide may then be purified from such antisera by, for example, affinity chromatography using the polypeptide coupled to a suitable solid support.

Monoclonal antibodies specific for an antigenic polypeptide of interest may be prepared, for example, using the technique of Kohler and Milstein, *Eur. J. Immunol.* 6:511–519, 1976, and improvements thereto. Briefly, these methods involve the preparation of immortal cell lines capable of producing antibodies having the desired specificity (i.e., reactivity with the polypeptide of interest). Such cell lines may be produced, for example, from spleen cells obtained from an animal immunized as described above. The spleen cells are then immortalized by, for example, fusion with a myeloma cell fusion partner, preferably one that is syngeneic with the immunized animal. A variety of fusion techniques may be employed. For example, the spleen cells and myeloma cells may be combined with a nonionic detergent for a few minutes and then plated at low density on a selective medium that supports the growth of hybrid cells, but not myeloma cells. A preferred selection technique uses HAT (hypoxanthine, aminopterin, thymidine) selection. After a sufficient time, usually about 1 to 2 weeks, colonies of hybrids are observed. Single colonies are selected and their culture supernatants tested for binding activity against the polypeptide. Hybridomas having high reactivity and specificity are preferred.

Monoclonal antibodies may be isolated from the supernatants of growing hybridoma colonies. In addition, various techniques may be employed to enhance the yield, such as injection of the hybridoma cell line into the peritoneal cavity of a suitable vertebrate host, such as a mouse. Monoclonal antibodies may then be harvested from the ascites fluid or the blood. Contaminants may be removed from the antibodies by conventional techniques, such as chromatography, gel filtration, precipitation, and extraction. The polypeptides of this invention may be used in the purification process in, for example, an affinity chromatography step.

A number of therapeutically useful molecules are known in the art which comprise antigen-binding sites that are capable of exhibiting immunological binding properties of an antibody molecule. The proteolytic enzyme papain preferentially cleaves IgG molecules to yield several fragments, two of which (the "F(ab)" fragments) each comprise a covalent heterodimer that includes an intact antigen-binding site. The enzyme pepsin is able to cleave IgG molecules to provide several fragments, including the "F(ab')$_2$" fragment which comprises both antigen-binding sites. An "Fv" fragment can be produced by preferential proteolytic cleavage of an IgM, and on rare occasions IgG or IgA immunoglobulin molecule. Fv fragments are, however, more commonly derived using recombinant techniques known in the art. The Fv fragment includes a non-covalent $V_H$::$V_L$ heterodimer including an antigen-binding site which retains much of the antigen recognition and binding capabilities of the native antibody molecule. Inbar et al. (1972) Proc. Nat. Acad. Sci. USA 69:2659–2662; Hochman et al. (1976) Biochem 15:2706–2710; and Ehrlich et al. (1980) Biochem 19:4091–4096.

A single chain Fv ("sFv") polypeptide is a covalently linked $V_H$::$V_L$ heterodimer which is expressed from a gene fusion including VH- and VL-encoding genes linked by a peptide-encoding linker. Huston et al. (1988) Proc. Nat. Acad. Sci. USA 85(16):5879–5883. A number of methods have been described to discern chemical structures for converting the naturally aggregated—but chemically separated—light and heavy polypeptide chains from an antibody V region into an sFv molecule which will fold into a three dimensional structure substantially similar to the structure of an antigen-binding site. See, e.g., U.S. Pat. Nos. 5,091,513 and 5,132,405, to Huston et al.; and U.S. Pat. No. 4,946,778, to Ladner et al.

Each of the above-described molecules includes a heavy chain and a light chain CDR set, respectively interposed between a heavy chain and a light chain FR set which provide support to the CDRS and define the spatial relationship of the CDRs relative to each other. As used herein, the term "CDR set" refers to the three hypervariable regions of a heavy or light chain V region. Proceeding from the N-terminus of a heavy or light chain, these regions are denoted as "CDR1," "CDR2," and "CDR3" respectively. An antigen-binding site, therefore, includes six CDRs, comprising the CDR set from each of a heavy and a light chain V region. A polypeptide comprising a single CDR, (e.g., a CDR1, CDR2 or CDR3) is referred to herein as a "molecular recognition unit." Crystallographic analysis of a number of antigen-antibody complexes has demonstrated that the amino acid residues of CDRs form extensive contact with bound antigen, wherein the most extensive antigen contact is with the heavy chain CDR3. Thus, the molecular recognition units are primarily responsible for the specificity of an antigen-binding site.

As used herein, the term "FR set" refers to the four flanking amino acid sequences which frame the CDRs of a CDR set of a heavy or light chain V region. Some FR residues may contact bound antigen; however, FRs are primarily responsible for folding the V region into the antigen-binding site, particularly the FR residues directly adjacent to the CDRS. Within FRs, certain amino residues and certain structural features are very highly conserved. In this regard, all V region sequences contain an internal disulfide loop of around 90 amino acid residues. When the V regions fold into a binding-site, the CDRs are displayed as projecting loop motifs which form an antigen-binding surface. It is generally recognized that there are conserved structural regions of FRs which influence the folded shape of the CDR loops into certain "canonical" structures— regardless of the precise CDR amino acid sequence. Further, certain FR residues are known to participate in non-covalent interdomain contacts which stabilize the interaction of the antibody heavy and light chains.

A number of "humanized" antibody molecules comprising an antigen-binding site derived from a non-human immunoglobulin have been described, including chimeric antibodies having rodent V regions and their associated CDRs fused to human constant domains (Winter et al. (1991) Nature 349:293–299; Lobuglio et al. (1989) Proc. Nat. Acad. Sci. USA 86:4220–4224; Shaw et al. (1987) J Immunol. 138:4534–4538; and Brown et al. (1987) Cancer Res. 47:3577–3583), rodent CDRs grafted into a human supporting FR prior to fusion with an appropriate human antibody constant domain (Riechmann et al. (1988) Nature 332:323–327; Verhoeyen et al. (1988) Science 239:1534–1536; and Jones et al. (1986) Nature 321:522–525), and rodent CDRs supported by recombinantly veneered rodent FRs (European Patent Publication No. 519,596, published Dec. 23, 1992). These "humanized" molecules are designed to minimize unwanted immunological response toward rodent antihuman antibody molecules which limits the duration and effectiveness of therapeutic applications of those moieties in human recipients.

As used herein, the terms "veneered FRs" and "recombinantly veneered FRs" refer to the selective replacement of FR residues from, e.g., a rodent heavy or light chain V region, with human FR residues in order to provide a xenogeneic molecule comprising an antigen-binding site which retains substantially all of the native FR polypeptide folding structure. Veneering techniques are based on the understanding that the ligand binding characteristics of an antigen-binding site are determined primarily by the structure and relative disposition of the heavy and light chain CDR sets within the antigen-binding surface. Davies et al. (1990) Ann. Rev. Biochem. 59:439–473. Thus, antigen binding specificity can be preserved in a humanized antibody only wherein the CDR structures, their interaction with each other, and their interaction with the rest of the V region domains are carefully maintained. By using veneering techniques, exterior (e.g., solvent-accessible) FR residues which are readily encountered by the immune system are selectively replaced with human residues to provide a hybrid molecule that comprises either a weakly immunogenic, or substantially non-immunogenic veneered surface.

The process of veneering makes use of the available sequence data for human antibody variable domains compiled by Kabat et al., in Sequences of Proteins of Immunological Interest, 4th ed., (U.S. Dept. of Health and Human Services, U.S. Government Printing Office, 1987), updates to the Kabat database, and other accessible U.S. and foreign databases (both nucleic acid and protein). Solvent accessibilities of V region amino acids can be deduced from the known three-dimensional structure for human and murine antibody fragments. There are two general steps in veneering a murine antigen-binding site. Initially, the FRs of the variable domains of an antibody molecule of interest are compared with corresponding FR sequences of human variable domains obtained from the above-identified sources. The most homologous human V regions are then compared residue by residue to corresponding murine amino acids. The residues in the murine FR which differ from the human counterpart are replaced by the residues present in the human moiety using recombinant techniques well known in the art. Residue switching is only carried out with moieties which are at least partially exposed (solvent accessible), and care is exercised in the replacement of amino acid residues which may have a significant effect on the tertiary structure of V region domains, such as proline, glycine and charged amino acids.

In this manner, the resultant "veneered" murine antigen-binding sites are thus designed to retain the murine CDR residues, the residues substantially adjacent to the CDRs, the residues identified as buried or mostly buried (solvent inaccessible), the residues believed to participate in non-covalent (e.g., electrostatic and hydrophobic) contacts between heavy and light chain domains, and the residues from conserved structural regions of the FRs which are believed to influence the "canonical" tertiary structures of the CDR loops. These design criteria are then used to prepare recombinant nucleotide sequences which combine the CDRs of both the heavy and light chain of a murine antigen-binding site into human-appearing FRs that can be used to transfect mammalian cells for the expression of recombinant human antibodies which exhibit the antigen specificity of the murine antibody molecule.

In another embodiment of the invention, monoclonal antibodies of the present invention may be coupled to one or more therapeutic agents. Suitable agents in this regard include radionuclides, differentiation inducers, drugs, toxins, and derivatives thereof. Preferred radionuclides include $^{90}$Y, $^{123}$I, $^{125}$I, $^{131}$I, $^{186}$Re, $^{188}$Re, $^{211}$At, and $^{212}$Bi. Preferred drugs include methotrexate, and pyrimidine and purine analogs. Preferred differentiation inducers include phorbol esters and butyric acid. Preferred toxins include ricin, abrin, diptheria toxin, cholera toxin, gelonin, Pseudomonas exotoxin, Shigella toxin, and pokeweed antiviral protein.

A therapeutic agent may be coupled (e.g., covalently bonded) to a suitable monoclonal antibody either directly or indirectly (e.g., via a linker group). A direct reaction between an agent and an antibody is possible when each possesses a substituent capable of reacting with the other. For example, a nucleophilic group, such as an amino or sulfhydryl group, on one may be capable of reacting with a carbonyl-containing group, such as an anhydride or an acid halide, or with an alkyl group containing a good leaving group (e.g., a halide) on the other.

Alternatively, it may be desirable to couple a therapeutic agent and an antibody via a linker group. A linker group can function as a spacer to distance an antibody from an agent in order to avoid interference with binding capabilities. A linker group can also serve to increase the chemical reactivity of a substituent on an agent or an antibody, and thus increase the coupling efficiency. An increase in chemical reactivity may also facilitate the use of agents, or functional groups on agents, which otherwise would not be possible.

It will be evident to those skilled in the art that a variety of bifunctional or polyfunctional reagents, both homo- and hetero-functional (such as those described in the catalog of the Pierce Chemical Co., Rockford, Ill.), may be employed as the linker group. Coupling may be effected, for example, through amino groups, carboxyl groups, sulfhydryl groups or oxidized carbohydrate residues. There are numerous references describing such methodology, e.g., U.S. Pat. No. 4,671,958, to Rodwell et al.

Where a therapeutic agent is more potent when free from the antibody portion of the immunoconjugates of the present invention, it may be desirable to use a linker group which is cleavable during or upon internalization into a cell. A number of different cleavable linker groups have been described. The mechanisms for the intracellular release of an agent from these linker groups include cleavage by reduction of a disulfide bond (e.g., U.S. Pat. No. 4,489,710, to Spitler), by irradiation of a photolabile bond (e.g., U.S. Pat. No. 4,625,014, to Senter et al.), by hydrolysis of derivatized amino acid side chains (e.g., U.S. Pat. No. 4,638,045, to Kohn et al.), by serum complement-mediated hydrolysis (e.g., U.S. Pat. No. 4,671,958, to Rodwell et al.), and acid-catalyzed hydrolysis (e.g., U.S. Pat. No. 4,569,789, to Blattler et al.).

It may be desirable to couple more than one agent to an antibody. In one embodiment, multiple molecules of an agent are coupled to one antibody molecule. In another embodiment, more than one type of agent may be coupled to one antibody. Regardless of the particular embodiment, immunoconjugates with more than one agent may be prepared in a variety of ways. For example, more than one agent may be coupled directly to an antibody molecule, or linkers that provide multiple sites for attachment can be used. Alternatively, a carrier can be used.

A carrier may bear the agents in a variety of ways, including covalent bonding either directly or via a linker group. Suitable carriers include proteins such as albumins (e.g., U.S. Pat. No. 4,507,234, to Kato et al.), peptides and polysaccharides such as aminodextran (e.g., U.S. Pat. No. 4,699,784, to Shih et al.). A carrier may also bear an agent by noncovalent bonding or by encapsulation, such as within a liposome vesicle (e.g., U.S. Pat. Nos. 4,429,008 and 4,873,088). Carriers specific for radionuclide agents include radiohalogenated small molecules and chelating compounds. For example, U.S. Pat. No. 4,735,792 discloses representative radiohalogenated small molecules and their synthesis. A radionuclide chelate may be formed from chelating compounds that include those containing nitrogen and sulfur atoms as the donor atoms for binding the metal, or metal oxide, radionuclide. For example, U.S. Pat. No. 4,673,562, to Davison et al. discloses representative chelating compounds and their synthesis.

T Cell Compositions

The present invention, in another aspect, provides T cells specific for a tumor polypeptide disclosed herein, or for a variant or derivative thereof. Such cells may generally be prepared in vitro or ex vivo, using standard procedures. For example, T cells may be isolated from bone marrow, peripheral blood, or a fraction of bone marrow or peripheral blood of a patient, using a commercially available cell separation system, such as the Isolex™ System, available from Nexell Therapeutics, Inc. (Irvine, Calif.; see also U.S. Pat. No. 5,240,856; U.S. Pat. No. 5,215,926; WO 89/06280; WO 91/16116 and WO 92/07243). Alternatively, T cells may be derived from related or unrelated humans, non-human mammals, cell lines or cultures.

T cells may be stimulated with a polypeptide, polynucleotide encoding a polypeptide and/or an antigen presenting cell (APC) that expresses such a polypeptide. Such stimulation is performed under conditions and for a time sufficient to permit the generation of T cells that are specific for the polypeptide of interest. Preferably, a tumor polypeptide or polynucleotide of the invention is present within a delivery vehicle, such as a microsphere, to facilitate the generation of specific T cells.

T cells are considered to be specific for a polypeptide of the present invention if the T cells specifically proliferate, secrete cytokines or kill target cells coated with the polypeptide or expressing a gene encoding the polypeptide. T cell specificity may be evaluated using any of a variety of standard techniques. For example, within a chromium release assay or proliferation assay, a stimulation index of more than two fold increase in lysis and/or proliferation, compared to negative controls, indicates T cell specificity. Such assays may be performed, for example, as described in Chen et al., Cancer Res. 54:1065–1070, 1994. Alternatively, detection of the proliferation of T cells may be accomplished by a variety of known techniques. For example, T cell proliferation can be detected by measuring an increased rate of DNA synthesis (e.g., by pulse-labeling cultures of T cells with tritiated thymidine and measuring the amount of tritiated thymidine incorporated into DNA). Contact with a tumor polypeptide (100 ng/ml -100 $\mu$g/ml, preferably 200 ng/ml-25 $\mu$g/ml) for 3–7 days will typically result in at least a two fold increase in proliferation of the T cells. Contact as described above for 2–3 hours should result in activation of the T cells, as measured using standard cytokine assays in which a two fold increase in the level of cytokine release (e.g., TNF or IFN-$\gamma$) is indicative of T cell activation (see Coligan et al., Current Protocols in Immunology, vol. 1, Wiley Interscience (Greene 1998)). T cells that have been activated in response to a tumor polypeptide, polynucleotide or polypeptide-expressing APC may be $CD4^+$ and/or CD8+. Tumor polypeptide-specific T cells may be expanded using standard techniques. Within preferred embodiments, the T cells are derived from a patient, a related donor or an unrelated donor, and are administered to the patient following stimulation and expansion.

For therapeutic purposes, $CD^4+$ or $CD8^+$ T cells that proliferate in response to a tumor polypeptide, polynucleotide or APC can be expanded in number either in vitro or in vivo. Proliferation of such T cells in vitro may be accomplished in a variety of ways. For example, the T cells can be re-exposed to a tumor polypeptide, or a short peptide corresponding to an immunogenic portion of such a polypeptide, with or without the addition of T cell growth factors, such as interleukin-2, and/or stimulator cells that synthesize a tumor polypeptide. Alternatively, one or more T cells that proliferate in the presence of the tumor polypeptide can be expanded in number by cloning. Methods for cloning cells are well known in the art, and include limiting dilution.

Pharmaceutical Compositions

In additional embodiments, the present invention concerns formulation of one or more of the polynucleotide, polypeptide, T-cell and/or antibody compositions disclosed herein in pharmaceutically-acceptable carriers for administration to a cell or an animal, either alone, or in combination with one or more other modalities of therapy.

It will be understood that, if desired, a composition as disclosed herein may be administered in combination with other agents as well, such as, e.g., other proteins or polypeptides or various pharmaceutically-active agents. In fact, there is virtually no limit to other components that may also be included, given that the additional agents do not cause a significant adverse effect upon contact with the target cells or host tissues. The compositions may thus be delivered along with various other agents as required in the particular instance. Such compositions may be purified from host cells or other biological sources, or alternatively may be chemically synthesized as described herein. Likewise, such compositions may further comprise substituted or derivatized RNA or DNA compositions.

Therefore, in another aspect of the present invention, pharmaceutical compositions are provided comprising one or more of the polynucleotide, polypeptide, antibody, and/or T-cell compositions described herein in combination with a physiologically acceptable carrier. In certain preferred embodiments, the pharmaceutical compositions of the invention comprise immunogenic polynucleotide and/or polypeptide compositions of the invention for use in prophylactic and theraputic vaccine applications. Vaccine preparation is generally described in, for example, M. F. Powell and M. J. Newman, eds., "Vaccine Design (the subunit and adjuvant approach)," Plenum Press (NY, 1995). Generally, such compositions will comprise one or more polynucleotide and/or polypeptide compositions of the present invention in combination with one or more immunostimulants.

It will be apparent that any of the pharmaceutical compositions described herein can contain pharmaceutically acceptable salts of the polynucleotides and polypeptides of the invention. Such salts can be prepared, for example, from pharmaceutically acceptable non-toxic bases, including organic bases (e.g., salts of primary, secondary and tertiary amines and basic amino acids) and inorganic bases (e.g., sodium, potassium, lithium, ammonium, calcium and magnesium salts).

In another embodiment, illustrative immunogenic compositions, e.g., vaccine compositions, of the present invention comprise DNA encoding one or more of the polypeptides as described above, such that the polypeptide is generated in situ. As noted above, the polynucleotide may be administered within any of a variety of delivery systems known to those of ordinary skill in the art. Indeed, numerous gene delivery techniques are well known in the art, such as those described by Rolland, *Crit. Rev. Therap. Drug Carrier Systems* 15:143–198, 1998, and references cited therein. Appropriate polynucleotide expression systems will, of course, contain the necessary regulatory DNA regulatory sequences for expression in a patient (such as a suitable promoter and terminating signal). Alternatively, bacterial delivery systems may involve the administration of a bacterium (such as Bacillus-Calmette-Guerrin) that expresses an immunogenic portion of the polypeptide on its cell surface or secretes such an epitope.

Therefore, in certain embodiments, polynucleotides encoding immunogenic polypeptides described herein are introduced into suitable mammalian host cells for expression using any of a number of known viral-based systems. In one illustrative embodiment, retroviruses provide a convenient and effective platform for gene delivery systems. A selected nucleotide sequence encoding a polypeptide of the present invention can be inserted into a vector and packaged in retroviral particles using techniques known in the art. The recombinant virus can then be isolated and delivered to a subject. A number of illustrative retroviral systems have been described (e.g., U.S. Pat. No. 5,219,740; Miller and Rosman (1989) BioTechniques 7:980–990; Miller, A. D. (1990) Human Gene Therapy 1:5–14; Scarpa et al. (1991) Virology 180:849–852; Burns et al. (1993) Proc. Natl. Acad. Sci. USA 90:8033–8037; and Boris-Lawrie and Temin (1993) Cur. Opin. Genet. Develop. 3:102–109.

In addition, a number of illustrative adenovirus-based systems have also been described. Unlike retroviruses which integrate into the host genome, adenoviruses persist extrachromosomally thus minimizing the risks associated with insertional mutagenesis (Haj-Ahmad and Graham (1986) J. Virol. 57:267–274; Bett et al. (1993) J. Virol. 67:5911–5921; Mittereder et al. (1994) Human Gene Therapy 5:717–729; Seth et al. (1994) J. Virol. 68:933–940; Barr et al. (1994) Gene Therapy 1:51–58; Berkner, K. L. (1988) BioTechniques 6:616–629; and Rich et al. (1993) Human Gene Therapy 4:461–476).

Various adeno-associated virus (AAV) vector systems have also been developed for polynucleotide delivery. AAV vectors can be readily constructed using techniques well known in the art. See, e.g., U.S. Pat. Nos. 5,173,414 and 5,139,941; International Publication Nos. WO 92/01070 and WO 93/03769; Lebkowski et al. (1988) Molec. Cell. Biol. 8:3988–3996; Vincent et al. (1990) Vaccines 90 (Cold Spring Harbor Laboratory Press); Carter, B. J. (1992) Current Opinion in Biotechnology 3:533–539; Muzyczka, N. (1992) Current Topics in Microbiol. and Immunol. 158:97–129; Kotin, R. M. (1994) Human Gene Therapy 5:793–801; Shelling and Smith (1994) Gene Therapy 1:165–169; and Zhou et al. (1994) J. Exp. Med. 179:1867–1875.

Additional viral vectors useful for delivering the polynucleotides encoding polypeptides of the present invention by gene transfer include those derived from the pox family of viruses, such as vaccinia virus and avian poxvirus. By way of example, vaccinia virus recombinants expressing the novel molecules can be constructed as follows. The DNA encoding a polypeptide is first inserted into an appropriate vector so that it is adjacent to a vaccinia promoter and flanking vaccinia DNA sequences, such as the sequence encoding thymidine kinase (TK). This vector is then used to transfect cells which are simultaneously infected with vaccinia. Homologous recombination serves to insert the vaccinia promoter plus the gene encoding the polypeptide of interest into the viral genome. The resulting TK.sup.(−) recombinant can be selected by culturing the cells in the presence of 5-bromodeoxyuridine and picking viral plaques resistant thereto.

A vaccinia-based infection/transfection system can be conveniently used to provide for inducible, transient expression or coexpression of one or more polypeptides described herein in host cells of an organism. In this particular system, cells are first infected in vitro with a vaccinia virus recombinant that encodes the bacteriophage T7 RNA polymerase. This polymerase displays exquisite specificity in that it only transcribes templates bearing T7 promoters. Following infection, cells are transfected with the polynucleotide or polynucleotides of interest, driven by a T7 promoter. The polymerase expressed in the cytoplasm from the vaccinia virus recombinant transcribes the transfected DNA into RNA which is then translated into polypeptide by the host translational machinery. The method provides for high level, transient, cytoplasmic production of large quantities of RNA and its translation products. See, e.g., Elroy-Stein and Moss, Proc. Natl. Acad. Sci. USA (1990) 87:6743–6747; Fuerst et al. Proc. Natl. Acad. Sci. USA (1986) 83:8122–8126.

Alternatively, avipoxviruses, such as the fowlpox and canarypox viruses, can also be used to deliver the coding sequences of interest. Recombinant avipox viruses, expressing immunogens from mammalian pathogens, are known to confer protective immunity when administered to non-avian species. The use of an Avipox vector is particularly desirable in human and other mammalian species since members of the Avipox genus can only productively replicate in susceptible avian species and therefore are not infective in mammalian cells. Methods for producing recombinant Avipoxviruses are known in the art and employ genetic recombination, as described above with respect to the production of vaccinia viruses. See, e.g., WO 91/12882; WO 89/03429; and WO 92/03545.

Any of a number of alphavirus vectors can also be used for delivery of polynucleotide compositions of the present invention, such as those vectors described in U.S. Pat. Nos. 5,843,723; 6,015,686; 6,008,035 and 6,015,694. Certain vectors based on Venezuelan Equine Encephalitis (VEE) can also be used, illustrative examples of which can be found in U.S. Pat. Nos. 5,505,947 and 5,643,576.

Moreover, molecular conjugate vectors, such as the adenovirus chimeric vectors described in Michael et al. J. Biol. Chem. (1993) 268:6866–6869 and Wagner et al. Proc. Natl. Acad. Sci. USA (1992) 89:6099–6103, can also be used for gene delivery under the invention.

Additional illustrative information on these and other known viral-based delivery systems can be found, for example, in Fisher-Hoch et al., *Proc. Natl. Acad. Sci. USA* 86:317–321, 1989; Flexner et al., *Ann. N.Y. Acad. Sci.* 569:86–103, 1989; Flexner et al., *Vaccine* 8:17–21, 1990; U.S. Pat. Nos. 4,603,112, 4,769,330, and 5,017,487; WO 89/01973; U.S. Pat. No. 4,777,127; GB 2,200,651; EP 0,345,242; WO 91/02805; Berkner, *Biotechniques* 6:616–627, 1988; Rosenfeld et al., *Science* 252:431–434, 1991; Kolls et al., *Proc. Natl. Acad. Sci. USA* 91:215–219, 1994; Kass-Eisler et al., *Proc. Natl. Acad. Sci. USA* 90:11498–11502, 1993; Guzman et al., *Circulation* 88:2838–2848, 1993; and Guzman et al., *Cir. Res.* 73:1202–1207, 1993.

In certain embodiments, a polynucleotide may be integrated into the genome of a target cell. This integration may be in the specific location and orientation via homologous recombination (gene replacement) or it may be integrated in a random, non-specific location (gene augmentation). In yet further embodiments, the polynucleotide may be stably maintained in the cell as a separate, episomal segment of DNA. Such polynucleotide segments or "episomes" encode sequences sufficient to permit maintenance and replication independent of or in synchronization with the host cell cycle. The manner in which the expression construct is delivered to a cell and where in the cell the polynucleotide remains is dependent on the type of expression construct employed.

In another embodiment of the invention, a polynucleotide is administered/delivered as "naked" DNA, for example as described in Ulmer et al., *Science* 259:1745–1749, 1993 and reviewed by Cohen, *Science* 259:1691–1692, 1993. The uptake of naked DNA may be increased by coating the DNA onto biodegradable beads, which are efficiently transported into the cells.

In still another embodiment, a composition of the present invention can be delivered via a particle bombardment approach, many of which have been described. In one illustrative example, gas-driven particle acceleration can be achieved with devices such as those manufactured by Powderject Pharmaceuticals PLC (Oxford, UK) and Powderject Vaccines Inc. (Madison, Wis.), some examples of which are described in U.S. Pat. Nos. 5,846,796; 6,010,478; 5,865, 796; 5,584,807; and EP Patent No. 0500 799. This approach offers a needle-free delivery approach wherein a dry powder formulation of microscopic particles, such as polynucleotide or polypeptide particles, are accelerated to high speed within a helium gas jet generated by a hand held device, propelling the particles into a target tissue of interest.

In a related embodiment, other devices and methods that may be useful for gas-driven needle-less injection of compositions of the present invention include those provided by Bioject, Inc. (Portland, Oreg.), some examples of which are described in U.S. Pat. Nos. 4,790,824; 5,064,413; 5,312, 335; 5,383,851; 5,399,163; 5,520,639 and 5,993,412.

According to another embodiment, the pharmaceutical compositions described herein will comprise one or more immunostimulants in addition to the immunogenic polynucleotide, polypeptide, antibody, T-cell and/or APC compositions of this invention. An immunostimulant refers to essentially any substance that enhances or potentiates an immune response (antibody and/or cell-mediated) to an exogenous antigen. One preferred type of immunostimulant comprises an adjuvant. Many adjuvants contain a substance designed to protect the antigen from rapid catabolism, such as aluminum hydroxide or mineral oil, and a stimulator of immune responses, such as lipid A, *Bortadella pertussis* or *Mycobacterium tuberculosis* derived proteins. Certain adjuvants are commercially available as, for example, Freund's Incomplete Adjuvant and Complete Adjuvant (Difco Laboratories, Detroit, Mich.); Merck Adjuvant 65 (Merck and Company, Inc., Rahway, N.J.); AS-2 (SmithKline Beecham, Philadelphia, Pa.); aluminum salts such as aluminum hydroxide gel (alum) or aluminum phosphate; salts of calcium, iron or zinc; an insoluble suspension of acylated tyrosine; acylated sugars; cationically or anionically derivatized polysaccharides; polyphosphazenes; biodegradable microspheres; monophosphoryl lipid A and quil A. Cytokines, such as GM-CSF, interleukin-2, -7, -12, and other like growth factors, may also be used as adjuvants.

Within certain embodiments of the invention, the adjuvant composition is preferably one that induces an immune response predominantly of the Th1 type. High levels of Th1-type cytokines (e.g., IFN-γ, TNFα, IL-2 and IL-12) tend to favor the induction of cell mediated immune responses to an administered antigen. In contrast, high levels of Th2-type cytokines (e.g., IL-4, IL-5, IL-6 and IL-10) tend to favor the induction of humoral immune responses. Following application of a vaccine as provided herein, a patient will support an immune response that includes Th1- and Th2-type responses. Within a preferred embodiment, in which a response is predominantly Th1-type, the level of Th1-type cytokines will increase to a greater extent than the level of Th2-type cytokines. The levels of these cytokines may be readily assessed using standard assays. For a review of the families of cytokines, see Mosmann and Coffman, *Ann. Rev. Immunol.* 7:145–173, 1989.

Certain preferred adjuvants for eliciting a predominantly Th1-type response include, for example, a combination of monophosphoryl lipid A, preferably 3-de-O-acylated monophosphoryl lipid A, together with an aluminum salt. MPL® adjuvants are available from Corixa Corporation (Seattle, Wash.; see, for example, U.S. Pat. Nos. 4,436,727; 4,877, 611; 4,866,034 and 4,912,094). CpG-containing oligonucleotides (in which the CpG dinucleotide is unmethylated) also induce a predominantly Th1 response. Such oligonucleotides are well known and are described, for example, in WO 96/02555, WO 99/33488 and U.S. Pat. Nos. 6,008,200 and 5,856,462. Immunostimulatory DNA sequences are also described, for example, by Sato et al., *Science* 273:352, 1996. Another preferred adjuvant comprises a saponin, such as Quil A, or derivatives thereof, including QS21 and QS7 (Aquila Biopharmaceuticals Inc., Framingham, Mass.); Escin; Digitonin; or Gypsophila or *Chenopodium quinoa* saponins. Other preferred formulations include more than one saponin in the adjuvant combinations of the present invention, for example combinations of at least two of the following group comprising QS21, QS7, Quil A, β-escin, or digitonin.

Alternatively the saponin formulations may be combined with vaccine vehicles composed of chitosan or other polycationic polymers, polylactide and polylactide-co-glycolide particles, poly-N-acetyl glucosamine-based polymer matrix, particles composed of polysaccharides or chemically modified polysaccharides, liposomes and lipid-based particles, particles composed of glycerol monoesters, etc. The saponins may also be formulated in the presence of cholesterol to form particulate structures such as liposomes or ISCOMs. Furthermore, the saponins may be formulated together with a polyoxyethylene ether or ester, in either a non-particulate solution or suspension, or in a particulate structure such as a paucilamelar liposome or ISCOM. The saponins may also be formulated with excipients such as Carbopol$^R$ to increase viscosity, or may be formulated in a dry powder form with a powder excipient such as lactose.

In one preferred embodiment, the adjuvant system includes the combination of a monophosphoryl lipid A and a saponin derivative, such as the combination of QS21 and 3D-MPL® adjuvant, as described in WO 94/00153, or a less reactogenic composition where the QS21 is quenched with cholesterol, as described in WO 96/33739. Other preferred formulations comprise an oil-in-water emulsion and tocopherol. Another particularly preferred adjuvant formulation employing QS21, 3D-MPL® adjuvant and tocopherol in an oil-in-water emulsion is described in WO 95/17210.

Another enhanced adjuvant system involves the combination of a CpG-containing oligonucleotide and a saponin derivative particularly the combination of CpG and QS21 is disclosed in WO 00/09159. Preferably the formulation additionally comprises an oil in water emulsion and tocopherol.

Additional illustrative adjuvants for use in the pharmaceutical compositions of the invention include Montanide ISA 720 (Seppic, France), SAF (Chiron, Calif., United States), ISCOMS (CSL), MF-59 (Chiron), the SBAS series of adjuvants (e.g., SBAS-2 or SBAS-4, available from SmithKline Beecham, Rixensart, Belgium), Detox (Enhanzyn®) (Corixa, Hamilton, Mont.), RC-529 (Corixa, Hamilton, Mont.) and other aminoalkyl glucosaminide 4-phosphates (AGPs), such as those described in pending U.S. patent application Ser. Nos. 08/853,826 and 09/074,720, the disclosures of which are incorporated herein by reference in their entireties, and polyoxyethylene ether adjuvants such as those described in WO 99/52549A1.

Other preferred adjuvants include adjuvant molecules of the general formula (I): HO(CH$_2$CH$_2$O)$_n$—A—R,
wherein, n is 1–50, A is a bond or —C(O)—, R is C$_{1-50}$ alkyl or Phenyl C$_{1-50}$ alkyl.

One embodiment of the present invention consists of a vaccine formulation comprising a polyoxyethylene ether of general formula (I), wherein n is between 1 and 50, preferably 4–24, most preferably 9; the R component is C$_1$–C$_{50}$, preferably C$_4$–C$_{20}$ alkyl and most preferably C$_{12}$ alkyl, and A is a bond. The concentration of the polyoxyethylene ethers should be in the range 0.1–20%, preferably from 0.1–10%, and most preferably in the range 0.1–1%. Preferred polyoxyethylene ethers are selected from the following group: polyoxyethylene-9-lauryl ether, polyoxyethylene-9-steoryl ether, polyoxyethylene-8-steoryl ether, polyoxyethylene-4-lauryl ether, polyoxyethylene-35-lauryl ether, and polyoxyethylene-23-lauryl ether. Polyoxyethylene ethers such as polyoxyethylene lauryl ether are described in the Merck index (12$^{th}$ edition: entry 7717). These adjuvant molecules are described in WO 99/52549.

The polyoxyethylene ether according to the general formula (I) above may, if desired, be combined with another adjuvant. For example, a preferred adjuvant combination is preferably with CpG as described in the pending UK patent application GB 9820956.2.

According to another embodiment of this invention, an immunogenic composition described herein is delivered to a host via antigen presenting cells (APCs), such as dendritic cells, macrophages, B cells, monocytes and other cells that may be engineered to be efficient APCs. Such cells may, but need not, be genetically modified to increase the capacity for presenting the antigen, to improve activation and/or maintenance of the T cell response, to have anti-tumor effects per se and/or to be immunologically compatible with the receiver (i.e., matched HLA haplotype). APCs may generally be isolated from any of a variety of biological fluids and organs, including tumor and peritumoral tissues, and may be autologous, allogeneic, syngeneic or xenogeneic cells.

Certain preferred embodiments of the present invention use dendritic cells or progenitors thereof as antigen-presenting cells. Dendritic cells are highly potent APCs (Banchereau and Steinman, Nature 392:245–251, 1998) and have been shown to be effective as a physiological adjuvant for eliciting prophylactic or therapeutic antitumor immunity (see Timmerman and Levy, Ann. Rev. Med. 50:507–529, 1999). In general, dendritic cells may be identified based on their typical shape (stellate in situ, with marked cytoplasmic processes (dendrites) visible in vitro), their ability to take up, process and present antigens with high efficiency and their ability to activate naive T cell responses. Dendritic cells may, of course, be engineered to express specific cell-surface receptors or ligands that are not commonly found on dendritic cells in vivo or ex vivo, and such modified dendritic cells are contemplated by the present invention. As an alternative to dendritic cells, secreted vesicles antigen-loaded dendritic cells (called exosomes) may be used within a vaccine (see Zitvogel et al., Nature Med. 4:594–600, 1998).

Dendritic cells and progenitors may be obtained from peripheral blood, bone marrow, tumor-infiltrating cells, peritumoral tissues-infiltrating cells, lymph nodes, spleen, skin, umbilical cord blood or any other suitable tissue or fluid. For example, dendritic cells may be differentiated ex vivo by adding a combination of cytokines such as GM-CSF, IL-4, IL-13 and/or TNFα to cultures of monocytes harvested from peripheral blood. Alternatively, CD34 positive cells harvested from peripheral blood, umbilical cord blood or bone marrow may be differentiated into dendritic cells by adding to the culture medium combinations of GM-CSF, IL-3, TNFα, CD40 ligand, LPS, flt3 ligand and/or other compound(s) that induce differentiation, maturation and proliferation of dendritic cells.

Dendritic cells are conveniently categorized as "immature" and "mature" cells, which allows a simple way to discriminate between two well characterized phenotypes. However, this nomenclature should not be construed to exclude all possible intermediate stages of differentiation. Immature dendritic cells are characterized as APC with a high capacity for antigen uptake and processing, which correlates with the high expression of Fcγ receptor and mannose receptor. The mature phenotype is typically characterized by a lower expression of these markers, but a high expression of cell surface molecules responsible for T cell activation such as class I and class II MHC, adhesion molecules (e.g., CD54 and CD11) and costimulatory molecules (e.g., CD40, CD80, CD86 and 4-1BB).

APCs may generally be transfected with a polynucleotide of the invention (or portion or other variant thereof) such that the encoded polypeptide, or an immunogenic portion thereof, is expressed on the cell surface. Such transfection may take place ex vivo, and a pharmaceutical composition comprising such transfected cells may then be used for therapeutic purposes, as described herein. Alternatively, a gene delivery vehicle that targets a dendritic or other antigen presenting cell may be administered to a patient, resulting in transfection that occurs in vivo. In vivo and ex vivo transfection of dendritic cells, for example, may generally be performed using any methods known in the art, such as those described in WO 97/24447, or the gene gun approach described by Mahvi et al., *Immunology and cell Biology* 75:456–460, 1997. Antigen loading of dendritic cells may be achieved by incubating dendritic cells or progenitor cells with the tumor polypeptide, DNA (naked or within a plasmid vector) or RNA; or with antigen-expressing recombinant bacterium or viruses (e.g., vaccinia, fowlpox, adenovirus or lentivirus vectors). Prior to loading, the polypeptide may be covalently conjugated to an immunological partner that provides T cell help (e.g., a carrier molecule). Alternatively, a dendritic cell may be pulsed with a non-conjugated immunological partner, separately or in the presence of the polypeptide.

While any suitable carrier known to those of ordinary skill in the art may be employed in the pharmaceutical compositions of this invention, the type of carrier will typically vary depending on the mode of administration. Compositions of the present invention may be formulated for any appropriate manner of administration, including for example, topical, oral, nasal, mucosal, intravenous, intracranial, intraperitoneal, subcutaneous and intramuscular administration.

Carriers for use within such pharmaceutical compositions are biocompatible, and may also be biodegradable. In certain embodiments, the formulation preferably provides a relatively constant level of active component release. In other embodiments, however, a more rapid rate of release immediately upon administration may be desired. The formulation of such compositions is well within the level of ordinary skill in the art using known techniques. Illustrative carriers useful in this regard include microparticles of poly(lactide-co-glycolide), polyacrylate, latex, starch, cellulose, dextran and the like. Other illustrative delayed-release carriers include supramolecular biovectors, which comprise a non-liquid hydrophilic core (e.g., a cross-linked polysaccharide or oligosaccharide) and, optionally, an external layer comprising an amphiphilic compound, such as a phospholipid (see e.g., U.S. Pat. No. 5,151,254 and PCT applications WO 94/20078, WO/94/23701 and WO 96/06638). The amount of active compound contained within a sustained release formulation depends upon the site of implantation, the rate and expected duration of release and the nature of the condition to be treated or prevented.

In another illustrative embodiment, biodegradable microspheres (e.g., polylactate polyglycolate) are employed as carriers for the compositions of this invention. Suitable biodegradable microspheres are disclosed, for example, in U.S. Pat. Nos. 4,897,268; 5,075,109; 5,928,647; 5,811,128; 5,820,883; 5,853,763; 5,814,344, 5,407,609 and 5,942,252. Modified hepatitis B core protein carrier systems. such as described in WO/99 40934, and references cited therein, will also be useful for many applications. Another illustrative carrier/delivery system employs a carrier comprising particulate-protein complexes, such as those described in U.S. Pat. No. 5,928,647, which are capable of inducing a class I-restricted cytotoxic T lymphocyte responses in a host.

The pharmaceutical compositions of the invention will often further comprise one or more buffers (e.g., neutral buffered saline or phosphate buffered saline), carbohydrates (e.g., glucose, mannose, sucrose or dextrans), mannitol, proteins, polypeptides or amino acids such as glycine, antioxidants, bacteriostats, chelating agents such as EDTA or glutathione, adjuvants (e.g., aluminum hydroxide), solutes that render the formulation isotonic, hypotonic or weakly hypertonic with the blood of a recipient, suspending agents, thickening agents and/or preservatives. Alternatively, compositions of the present invention may be formulated as a lyophilizate.

The pharmaceutical compositions described herein may be presented in unit-dose or multi-dose containers, such as sealed ampoules or vials. Such containers are typically sealed in such a way to preserve the sterility and stability of the formulation until use. In general, formulations may be stored as suspensions, solutions or emulsions in oily or aqueous vehicles. Alternatively, a pharmaceutical composition may be stored in a freeze-dried condition requiring only the addition of a sterile liquid carrier immediately prior to use.

The development of suitable dosing and treatment regimens for using the particular compositions described herein in a variety of treatment regimens, including e.g., oral, parenteral, intravenous, intranasal, and intramuscular administration and formulation, is well known in the art, some of which are briefly discussed below for general purposes of illustration.

In certain applications, the pharmaceutical compositions disclosed herein may be delivered via oral administration to an animal. As such, these compositions may be formulated with an inert diluent or with an assimilable edible carrier, or they may be enclosed in hard- or soft-shell gelatin capsule, or they may be compressed into tablets, or they may be incorporated directly with the food of the diet.

The active compounds may even be incorporated with excipients and used in the form of ingestible tablets, buccal tables, troches, capsules, elixirs, suspensions, syrups, wafers, and the like (see, for example, Mathiowitz et al., Nature Mar. 27, 1997;386(6623):410–4; Hwang et al., Crit Rev Ther Drug Carrier Syst 1998;15(3):243–84; U.S. Pat. No. 5,641,515; U.S. Pat. No. 5,580,579 and U.S. Pat. No. 5,792,451). Tablets, troches, pills, capsules and the like may also contain any of a variety of additional components, for example, a binder, such as gum tragacanth, acacia, cornstarch, or gelatin; excipients, such as dicalcium phosphate; a disintegrating agent, such as corn starch, potato starch, alginic acid and the like; a lubricant, such as magnesium stearate; and a sweetening agent, such as sucrose, lactose or saccharin may be added or a flavoring agent, such as peppermint, oil of wintergreen, or cherry flavoring. When the dosage unit form is a capsule, it may contain, in addition to materials of the above type, a liquid carrier. Various other materials may be present as coatings or to otherwise modify the physical form of the dosage unit. For instance, tablets, pills, or capsules may be coated with shellac, sugar, or both. Of course, any material used in preparing any dosage unit form should be pharmaceutically pure and substantially non-toxic in the amounts employed. In addition, the active compounds may be incorporated into sustained-release preparation and formulations.

Typically, these formulations will contain at least about 0.1% of the active compound or more, although the percentage of the active ingredient(s) may, of course, be varied and may conveniently be between about 1 or 2% and about 60% or 70% or more of the weight or volume of the total formulation. Naturally, the amount of active compound(s) in each therapeutically useful composition may be prepared is such a way that a suitable dosage will be obtained in any given unit dose of the compound. Factors such as solubility, bioavailability, biological half-life, route of administration, product shelf life, as well as other pharmacological considerations will be contemplated by one skilled in the art of preparing such pharmaceutical formulations, and as such, a variety of dosages and treatment regimens may be desirable.

For oral administration the compositions of the present invention may alternatively be incorporated with one or more excipients in the form of a mouthwash, dentifrice, buccal tablet, oral spray, or sublingual orally-administered formulation. Alternatively, the active ingredient may be incorporated into an oral solution such as one containing sodium borate, glycerin and potassium bicarbonate, or dispersed in a dentifrice, or added in a therapeutically-effective amount to a composition that may include water, binders, abrasives, flavoring agents, foaming agents, and humectants. Alternatively the compositions may be fashioned into a tablet or solution form that may be placed under the tongue or otherwise dissolved in the mouth.

In certain circumstances it will be desirable to deliver the pharmaceutical compositions disclosed herein parenterally, intravenously, intramuscularly, or even intraperitoneally. Such approaches are well known to the skilled artisan, some of which are further described, for example, in U.S. Pat. No. 5,543,158; U.S. Pat. No. 5,641,515 and U.S. Pat. No. 5,399,363. In certain embodiments, solutions of the active compounds as free base or pharmacologically acceptable salts may be prepared in water suitably mixed with a surfactant, such as hydroxypropylcellulose. Dispersions may also be prepared in glycerol, liquid polyethylene glycols, and mixtures thereof and in oils. Under ordinary conditions of storage and use, these preparations generally will contain a preservative to prevent the growth of microorganisms.

Illustrative pharmaceutical forms suitable for injectable use include sterile aqueous solutions or dispersions and sterile powders for the extemporaneous preparation of sterile injectable solutions or dispersions (for example, see U.S. Pat. No. 5,466,468). In all cases the form must be sterile and must be fluid to the extent that easy syringability exists. It must be stable under the conditions of manufacture and storage and must be preserved against the contaminating action of microorganisms, such as bacteria and fungi. The carrier can be a solvent or dispersion medium containing, for example, water, ethanol, polyol (e.g., glycerol, propylene glycol, and liquid polyethylene glycol, and the like), suitable mixtures thereof, and/or vegetable oils. Proper fluidity may be maintained, for example, by the use of a coating, such as lecithin, by the maintenance of the required particle size in the case of dispersion and/or by the use of surfactants. The prevention of the action of microorganisms can be facilitated by various antibacterial and antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

In one embodiment, for parenteral administration in an aqueous solution, the solution should be suitably buffered if necessary and the liquid diluent first rendered isotonic with sufficient saline or glucose. These particular aqueous solutions are especially suitable for intravenous, intramuscular, subcutaneous and intraperitoneal administration. In this connection, a sterile aqueous medium that can be employed will be known to those of skill in the art in light of the present disclosure. For example, one dosage may be dissolved in 1 ml of isotonic NaCl solution and either added to 1000 ml of hypodermoclysis fluid or injected at the proposed site of infusion, (see for example, "Remington's Pharmaceutical Sciences" 15th Edition, pages 1035–1038 and 1570–1580). Some variation in dosage will necessarily occur depending on the condition of the subject being treated. Moreover, for human administration, preparations will of course preferably meet sterility, pyrogenicity, and the general safety and purity standards as required by FDA Office of Biologics standards.

In another embodiment of the invention, the compositions disclosed herein may be formulated in a neutral or salt form. Illustrative pharmaceutically-acceptable salts include the acid addition salts (formed with the free amino groups of the protein) and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as isopropylamine, trimethylamine, histidine, procaine and the like. Upon formulation, solutions will be administered in a manner compatible with the dosage formulation and in such amount as is therapeutically effective.

The carriers can further comprise any and all solvents, dispersion media, vehicles, coatings, diluents, antibacterial and antifungal agents, isotonic and absorption delaying agents, buffers, carrier solutions, suspensions, colloids, and the like. The use of such media and agents for pharmaceutical active substances is well known in the art. Except insofar as any conventional media or agent is incompatible with the active ingredient, its use in the therapeutic compositions is contemplated. Supplementary active ingredients can also be incorporated into the compositions. The phrase "pharmaceutically-acceptable" refers to molecular entities and compositions that do not produce an allergic or similar untoward reaction when administered to a human.

In certain embodiments, the pharmaceutical compositions may be delivered by intranasal sprays, inhalation, and/or other aerosol delivery vehicles. Methods for delivering genes, nucleic acids, and peptide compositions directly to the lungs via nasal aerosol sprays has been described, e.g., in U.S. Pat. No. 5,756,353 and U.S. Pat. No. 5,804,212. Likewise, the delivery of drugs using intranasal microparticle resins (Takenaga et al., J Controlled Release Mar. 2, 1998;52(1–2):81–7) and lysophosphatidyl-glycerol compounds (U.S. Pat. No. 5,725,871) are also well-known in the pharmaceutical arts. Likewise, illustrative transmucosal drug delivery in the form of a polytetrafluoroetheylene support matrix is described in U.S. Pat. No. 5,780,045.

In certain embodiments, liposomes, liposomes, nanocapsules, microparticles, lipid particles, vesicles, and the like, are used for the introduction of the compositions of the present invention into suitable host cells/organisms. In particular, the compositions of the present invention may be formulated for delivery either encapsulated in a lipid particle, a liposome, a vesicle, a nanosphere, or a nanoparticle or the like. Alternatively, compositions of the present invention can be bound, either covalently or non-covalently, to the surface of such carrier vehicles.

The formation and use of liposome and liposome-like preparations as potential drug carriers is generally known to those of skill in the art (see for example, Lasic, Trends Biotechnol July 1998;16(7):307–21; Takakura, Nippon Rinsho March 1998;56(3):691–5; Chandran et al., Indian J Exp Biol. August 1997;35(8):801–9; Margalit, Crit Rev Ther Drug Carrier Syst. 1995;12(2–3):233–61; U.S. Pat. No. 5,567,434; U.S. Pat. No. 5,552,157; U.S. Pat. No. 5,565,213; U.S. Pat. No. 5,738,868 and U.S. Pat. No. 5,795,587, each specifically incorporated herein by reference in its entirety).

Liposomes have been used successfully with a number of cell types that are normally difficult to transfect by other procedures, including T cell suspensions, primary hepatocyte cultures and PC 12 cells (Renneisen et al., J Biol Chem.

Sep. 25, 1990;265(27):16337–42; Muller et al., DNA Cell Biol. April 1990;9(3):221–9). In addition, liposomes are free of the DNA length constraints that are typical of viral-based delivery systems. Liposomes have been used effectively to introduce genes, various drugs, radiotherapeutic agents, enzymes, viruses, transcription factors, allosteric effectors and the like, into a variety of cultured cell lines and animals. Furthermore, he use of liposomes does not appear to be associated with autoimmune responses or unacceptable toxicity after systemic delivery.

In certain embodiments, liposomes are formed from phospholipids that are dispersed in an aqueous medium and spontaneously form multilamellar concentric bilayer vesicles (also termed multilamellar vesicles (MLVs).

Alternatively, in other embodiments, the invention provides for pharmaceutically-acceptable nanocapsule formulations of the compositions of the present invention. Nanocapsules can generally entrap compounds in a stable and reproducible way (see, for example, Quintanar-Guerrero et al., Drug Dev Ind Pharm. December 1998;24(12):1113–28). To avoid side effects due to intracellular polymeric overloading, such ultrafine particles (sized around 0.1 $\mu$m) may be designed using polymers able to be degraded in vivo. Such particles can be made as described, for example, by Couvreur et al., Crit Rev Ther Drug Carrier Syst. 1988;5(1): 1–20; zur Muhlen et al., Eur J Pharm Biopharm. March 1998;45(2):149–55; Zambaux et al. J Controlled Release. Jan. 2, 1998;50(1–3):31–40; an Pat. No. 5,145,684.

Cancer Therapeutic Methods

In further aspects of the present invention, the pharmaceutical compositions described herein may be used for the treatment of cancer, particularly for the immunotherapy of lung cancer. Within such methods, the pharmaceutical compositions described herein are administered to a patient, typically a warm-blooded animal, preferably a human. A patient may or may not be afflicted with cancer. Accordingly, the above pharmaceutical compositions may be used to prevent the development of a cancer or to treat a patient afflicted with a cancer. Pharmaceutical compositions and vaccines may be administered either prior to or following surgical removal of primary tumors and/or treatment such as administration of radiotherapy or conventional chemotherapeutic drugs. As discussed above, administration of the pharmaceutical compositions may be by any suitable method, including administration by intravenous, intraperitoneal, intramuscular, subcutaneous, intranasal, intradermal, anal, vaginal, topical and oral routes.

Within certain embodiments, immunotherapy may be active immunotherapy, in which treatment relies on the in vivo stimulation of the endogenous host immune system to react against tumors with the administration of immune response-modifying agents (such as polypeptides and polynucleotides as provided herein).

Within other embodiments, immunotherapy may be passive immunotherapy, in which treatment involves the delivery of agents with established tumor-immune reactivity (such as effector cells or antibodies) that can directly or indirectly mediate antitumor effects and does not necessarily depend on an intact host immune system. Examples of effector cells include T cells as discussed above, T lymphocytes (such as $CD8^+$ cytotoxic T lymphocytes and $CD4^+$ T-helper tumor-infiltrating lymphocytes), killer cells (such as Natural Killer cells and lymphokine-activated killer cells), B cells and antigen-presenting cells (such as dendritic cells and macrophages) expressing a polypeptide provided herein. T cell receptors and antibody receptors specific for the polypeptides recited herein may be cloned, expressed and transferred into other vectors or effector cells for adoptive immunotherapy. The polypeptides provided herein may also be used to generate antibodies or anti-idiotypic antibodies (as described above and in U.S. Pat. No. 4,918,164) for passive immunotherapy.

Effector cells may generally be obtained in sufficient quantities for adoptive immunotherapy by growth in vitro, as described herein. Culture conditions for expanding single antigen-specific effector cells to several billion in number with retention of antigen recognition in vivo are well known in the art. Such in vitro culture conditions typically use intermittent stimulation with antigen, often in the presence of cytokines (such as IL-2) and non-dividing feeder cells. As noted above, immunoreactive polypeptides as provided herein may be used to rapidly expand antigen-specific T cell cultures in order to generate a sufficient number of cells for immunotherapy. In particular, antigen-presenting cells, such as dendritic, macrophage, monocyte, fibroblast and/or B cells, may be pulsed with immunoreactive polypeptides or transfected with one or more polynucleotides using standard techniques well known in the art. For example, antigen-presenting cells can be transfected with a polynucleotide having a promoter appropriate for increasing expression in a recombinant virus or other expression system. Cultured effector cells for use in therapy must be able to grow and distribute widely, and to survive long term in vivo. Studies have shown that cultured effector cells can be induced to grow in vivo and to survive long term in substantial numbers by repeated stimulation with antigen supplemented with IL-2 (see, for example, Cheever et al., *Immunological Reviews* 157:177, 1997).

Alternatively, a vector expressing a polypeptide recited herein may be introduced into antigen presenting cells taken from a patient and clonally propagated ex vivo for transplant back into the same patient. Transfected cells may be reintroduced into the patient using any means known in the art, preferably in sterile form by intravenous, intracavitary, intraperitoneal or intratumor administration.

Routes and frequency of administration of the therapeutic compositions described herein, as well as dosage, will vary from individual to individual, and may be readily established using standard techniques. In general, the pharmaceutical compositions and vaccines may be administered by injection (e.g., intracutaneous, intramuscular, intravenous or subcutaneous), intranasally (e.g., by aspiration) or orally. Preferably, between 1 and 10 doses may be administered over a 52 week period. Preferably, 6 doses are administered, at intervals of 1 month, and booster vaccinations may be given periodically thereafter. Alternate protocols may be appropriate for individual patients. A suitable dose is an amount of a compound that, when administered as described above, is capable of promoting an anti-tumor immune response, and is at least 10–50% above the basal (i.e., untreated) level. Such response can be monitored by measuring the anti-tumor antibodies in a patient or by vaccine-dependent generation of cytolytic effector cells capable of killing the patient's tumor cells in vitro. Such vaccines should also be capable of causing an immune response that leads to an improved clinical outcome (e.g., more frequent remissions, complete or partial or longer disease-free survival) in vaccinated patients as compared to non-vaccinated patients. In general, for pharmaceutical compositions and vaccines comprising one or more polypeptides, the amount of each polypeptide present in a dose ranges from about 25 $\mu$g to 5 mg per kg of host. Suitable dose sizes will vary with the size of the patient, but will typically range from about 0.1 mL to about 5 mL.

In general, an appropriate dosage and treatment regimen provides the active compound(s) in an amount sufficient to provide therapeutic and/or prophylactic benefit. Such a response can be monitored by establishing an improved clinical outcome (e.g., more frequent remissions, complete or partial, or longer disease-free survival) in treated patients as compared to non-treated patients. Increases in preexisting immune responses to a tumor protein generally correlate with an improved clinical outcome. Such immune responses may generally be evaluated using standard proliferation, cytotoxicity or cytokine assays, which may be performed using samples obtained from a patient before and after treatment.

Cancer Detection and Diagnostic Compositions Methods and Kits

In general, a cancer may be detected in a patient based on the presence of one or more lung tumor proteins and/or polynucleotides encoding such proteins in a biological sample (for example, blood, sera, sputum urine and/or tumor biopsies) obtained from the patient. In other words, such proteins may be used as markers to indicate the presence or absence of a cancer such as lung cancer. In addition, such proteins may be useful for the detection of other cancers. The binding agents provided herein generally permit detection of the level of antigen that binds to the agent in the biological sample. Polynucleotide primers and probes may be used to detect the level of mRNA encoding a tumor protein, which is also indicative of the presence or absence of a cancer. In general, a lung tumor sequence should be present at a level that is at least three fold higher in tumor tissue than in normal tissue There are a variety of assay formats known to those of ordinary skill in the art for using a binding agent to detect polypeptide markers in a sample. See, e.g., Harlow and Lane, *Antibodies: A Laboratory Manual*, Cold Spring Harbor Laboratory, 1988. In general, the presence or absence of a cancer in a patient may be determined by (a) contacting a biological sample obtained from a patient with a binding agent; (b) detecting in the sample a level of polypeptide that binds to the binding agent; and (c) comparing the level of polypeptide with a predetermined cut-off value.

In a preferred embodiment, the assay involves the use of binding agent immobilized on a solid support to bind to and remove the polypeptide from the remainder of the sample. The bound polypeptide may then be detected using a detection reagent that contains a reporter group and specifically binds to the binding agent/polypeptide complex. Such detection reagents may comprise, for example, a binding agent that specifically binds to the polypeptide or an antibody or other agent that specifically binds to the binding agent, such as an anti-immunoglobulin, protein G, protein A or a lectin. Alternatively, a competitive assay may be utilized, in which a polypeptide is labeled with a reporter group and allowed to bind to the immobilized binding agent after incubation of the binding agent with the sample. The extent to which components of the sample inhibit the binding of the labeled polypeptide to the binding agent is indicative of the reactivity of the sample with the immobilized binding agent. Suitable polypeptides for use within such assays include full length lung tumor proteins and polypeptide portions thereof to which the binding agent binds, as described above.

The solid support may be any material known to those of ordinary skill in the art to which the tumor protein may be attached. For example, the solid support may be a test well in a microtiter plate or a nitrocellulose or other suitable membrane. Alternatively, the support may be a bead or disc, such as glass, fiberglass, latex or a plastic material such as polystyrene or polyvinylchloride. The support may also be a magnetic particle or a fiber optic sensor, such as those disclosed, for example, in U.S. Pat. No. 5,359,681. The binding agent may be immobilized on the solid support using a variety of techniques known to those of skill in the art, which are amply described in the patent and scientific literature. In the context of the present invention, the term "immobilization" refers to both noncovalent association, such as adsorption, and covalent attachment (which may be a direct linkage between the agent and functional groups on the support or may be a linkage by way of a cross-linking agent). Immobilization by adsorption to a well in a microtiter plate or to a membrane is preferred. In such cases, adsorption may be achieved by contacting the binding agent, in a suitable buffer, with the solid support for a suitable amount of time. The contact time varies with temperature, but is typically between about 1 hour and about 1 day. In general, contacting a well of a plastic microtiter plate (such as polystyrene or polyvinylchloride) with an amount of binding agent ranging from about 10 ng to about 10 $\mu$g, and preferably about 100 ng to about 1 $\mu$g, is sufficient to immobilize an adequate amount of binding agent.

Covalent attachment of binding agent to a solid support may generally be achieved by first reacting the support with a bifunctional reagent that will react with both the support and a functional group, such as a hydroxyl or amino group, on the binding agent. For example, the binding agent may be covalently attached to supports having an appropriate polymer coating using benzoquinone or by condensation of an aldehyde group on the support with an amine and an active hydrogen on the binding partner (see, e.g., Pierce Immunotechnology Catalog and Handbook, 1991, at A12–A13).

In certain embodiments, the assay is a two-antibody sandwich assay. This assay may be performed by first contacting an antibody that has been immobilized on a solid support, commonly the well of a microtiter plate, with the sample, such that polypeptides within the sample are allowed to bind to the immobilized antibody. Unbound sample is then removed from the immobilized polypeptide-antibody complexes and a detection reagent (preferably a second antibody capable of binding to a different site on the polypeptide) containing a reporter group is added. The amount of detection reagent that remains bound to the solid support is then determined using a method appropriate for the specific reporter group.

More specifically, once the antibody is immobilized on the support as described above, the remaining protein binding sites on the support are typically blocked. Any suitable blocking agent known to those of ordinary skill in the art, such as bovine serum albumin or Tween 20™ (Sigma Chemical Co., St. Louis, Mo.). The immobilized antibody is then incubated with the sample, and polypeptide is allowed to bind to the antibody. The sample may be diluted with a suitable diluent, such as phosphate-buffered saline (PBS) prior to incubation. In general, an appropriate contact time (i.e., incubation time) is a period of time that is sufficient to detect the presence of polypeptide within a sample obtained from an individual with lung cancer. Preferably, the contact time is sufficient to achieve a level of binding that is at least about 95% of that achieved at equilibrium between bound and unbound polypeptide. Those of ordinary skill in the art will recognize that the time necessary to achieve equilibrium may be readily determined by assaying the level of binding that occurs over a period of time. At room temperature, an incubation time of about 30 minutes is generally sufficient.

Unbound sample may then be removed by washing the solid support with an appropriate buffer, such as PBS containing 0.1% Tween 20™. The second antibody, which contains a reporter group, may then be added to the solid support. Preferred reporter groups include those groups recited above.

The detection reagent is then incubated with the immobilized antibody-polypeptide complex for an amount of time sufficient to detect the bound polypeptide. An appropriate amount of time may generally be determined by assaying the level of binding that occurs over a period of time. Unbound detection reagent is then removed and bound detection reagent is detected using the reporter group. The method employed for detecting the reporter group depends upon the nature of the reporter group. For radioactive groups, scintillation counting or autoradiographic methods are generally appropriate. Spectroscopic methods may be used to detect dyes, luminescent groups and fluorescent groups. Biotin may be detected using avidin, coupled to a different reporter group (commonly a radioactive or fluorescent group or an enzyme). Enzyme reporter groups may generally be detected by the addition of substrate (generally for a specific period of time), followed by spectroscopic or other analysis of the reaction products.

To determine the presence or absence of a cancer, such as lung cancer, the signal detected from the reporter group that remains bound to the solid support is generally compared to a signal that corresponds to a predetermined cut-off value. In one preferred embodiment, the cut-off value for the detection of a cancer is the average mean signal obtained when the immobilized antibody is incubated with samples from patients without the cancer. In general, a sample generating a signal that is three standard deviations above the predetermined cut-off value is considered positive for the cancer. In an alternate preferred embodiment, the cut-off value is determined using a Receiver Operator Curve, according to the method of Sackett et al., *Clinical Epidemiology: A Basic Science for Clinical Medicine*, Little Brown and Co., 1985, p. 106–7. Briefly, in this embodiment, the cut-off value may be determined from a plot of pairs of true positive rates (i.e., sensitivity) and false positive rates (100%-specificity) that correspond to each possible cut-off value for the diagnostic test result. The cut-off value on the plot that is the closest to the upper left-hand corner (i.e., the value that encloses the largest area) is the most accurate cut-off value, and a sample generating a signal that is higher than the cut-off value determined by this method may be considered positive. Alternatively, the cut-off value may be shifted to the left along the plot, to minimize the false positive rate, or to the right, to minimize the false negative rate. In general, a sample generating a signal that is higher than the cut-off value determined by this method is considered positive for a cancer.

In a related embodiment, the assay is performed in a flow-through or strip test format, wherein the binding agent is immobilized on a membrane, such as nitrocellulose. In the flow-through test, polypeptides within the sample bind to the immobilized binding agent as the sample passes through the membrane. A second, labeled binding agent then binds to the binding agent-polypeptide complex as a solution containing the second binding agent flows through the membrane. The detection of bound second binding agent may then be performed as described above. In the strip test format, one end of the membrane to which binding agent is bound is immersed in a solution containing the sample. The sample migrates along the membrane through a region containing second binding agent and to the area of immobilized binding agent. Concentration of second binding agent at the area of immobilized antibody indicates the presence of a cancer. Typically, the concentration of second binding agent at that site generates a pattern, such as a line, that can be read visually. The absence of such a pattern indicates a negative result. In general, the amount of binding agent immobilized on the membrane is selected to generate a visually discernible pattern when the biological sample contains a level of polypeptide that would be sufficient to generate a positive signal in the two-antibody sandwich assay, in the format discussed above. Preferred binding agents for use in such assays are antibodies and antigen-binding fragments thereof. Preferably, the amount of antibody immobilized on the membrane ranges from about 25 ng to about 1 $\mu$g, and more preferably from about 50 ng to about 500 ng. Such tests can typically be performed with a very small amount of biological sample.

Of course, numerous other assay protocols exist that are suitable for use with the tumor proteins or binding agents of the present invention. The above descriptions are intended to be exemplary only. For example, it will be apparent to those of ordinary skill in the art that the above protocols may be readily modified to use tumor polypeptides to detect antibodies that bind to such polypeptides in a biological sample. The detection of such tumor protein specific antibodies may correlate with the presence of a cancer.

A cancer may also, or alternatively, be detected based on the presence of T cells that specifically react with a tumor protein in a biological sample. Within certain methods, a biological sample comprising $CD4^+$ and/or $CD8^+$ T cells isolated from a patient is incubated with a tumor polypeptide, a polynucleotide encoding such a polypeptide and/or an APC that expresses at least an immunogenic portion of such a polypeptide, and the presence or absence of specific activation of the T cells is detected. Suitable biological samples include, but are not limited to, isolated T cells. For example, T cells may be isolated from a patient by routine techniques (such as by Ficoll/Hypaque density gradient centrifugation of peripheral blood lymphocytes). T cells may be incubated in vitro for 2–9 days (typically 4 days) at 37° C. with polypeptide (e.g., 5–25 $\mu$g/ml). It may be desirable to incubate another aliquot of a T cell sample in the absence of tumor polypeptide to serve as a control. For $CD4^+$ T cells, activation is preferably detected by evaluating proliferation of the T cells. For $CD8^+$ T cells, activation is preferably detected by evaluating cytolytic activity. A level of proliferation that is at least two fold greater and/or a level of cytolytic activity that is at least 20% greater than in disease-free patients indicates the presence of a cancer in the patient.

As noted above, a cancer may also, or alternatively, be detected based on the level of mRNA encoding a tumor protein in a biological sample. For example, at least two oligonucleotide primers may be employed in a polymerase chain reaction (PCR) based assay to amplify a portion of a tumor cDNA derived from a biological sample, wherein at least one of the oligonucleotide primers is specific for (i.e., hybridizes to) a polynucleotide encoding the tumor protein. The amplified cDNA is then separated and detected using techniques well known in the art, such as gel electrophoresis. Similarly, oligonucleotide probes that specifically hybridize to a polynucleotide encoding a tumor protein may be used in a hybridization assay to detect the presence of polynucleotide encoding the tumor protein in a biological sample.

To permit hybridization under assay conditions, oligonucleotide primers and probes should comprise an oligonucleotide sequence that has at least about 60%, preferably at least about 75% and more preferably at least about 90%, identity to a portion of a polynucleotide encoding a tumor protein of the invention that is at least 10 nucleotides, and preferably at least 20 nucleotides, in length. Preferably, oligonucleotide primers and/or probes hybridize to a polynucleotide encoding a polypeptide described herein under moderately stringent conditions, as defined above. Oligonucleotide primers and/or probes which may be usefully employed in the diagnostic methods described herein preferably are at least 10–40 nucleotides in length. In a preferred embodiment, the oligonucleotide primers comprise at least 10 contiguous nucleotides, more preferably at least 15 contiguous nucleotides, of a DNA molecule having a sequence as disclosed herein. Techniques for both PCR based assays and hybridization assays are well known in the art (see, for example, Mullis et al., *Cold Spring Harbor Symp. Quant. Biol.*, 51:263, 1987; Erlich ed., *PCR Technology*, Stockton Press, N.Y., 1989).

One preferred assay employs RT-PCR, in which PCR is applied in conjunction with reverse transcription. Typically, RNA is extracted from a biological sample, such as biopsy tissue, and is reverse transcribed to produce cDNA molecules. PCR amplification using at least one specific primer generates a cDNA molecule, which may be separated and visualized using, for example, gel electrophoresis. Amplification may be performed on biological samples taken from a test patient and from an individual who is not afflicted with a cancer. The amplification reaction may be performed on several dilutions of cDNA spanning two orders of magnitude. A two-fold or greater increase in expression in several dilutions of the test patient sample as compared to the same dilutions of the non-cancerous sample is typically considered positive.

In another embodiment, the compositions described herein may be used as markers for the progression of cancer. In this embodiment, assays as described above for the diagnosis of a cancer may be performed over time, and the change in the level of reactive polypeptide(s) or polynucleotide(s) evaluated. For example, the assays may be performed every 24–72 hours for a period of 6 months to 1 year, and thereafter performed as needed. In general, a cancer is progressing in those patients in whom the level of polypeptide or polynucleotide detected increases over time. In contrast, the cancer is not progressing when the level of reactive polypeptide or polynucleotide either remains constant or decreases with time.

Certain in vivo diagnostic assays may be performed directly on a tumor. One such assay involves contacting tumor cells with a binding agent. The bound binding agent may then be detected directly or indirectly via a reporter group. Such binding agents may also be used in histological applications. Alternatively, polynucleotide probes may be used within such applications.

As noted above, to improve sensitivity, multiple tumor protein markers may be assayed within a given sample. It will be apparent that binding agents specific for different proteins provided herein may be combined within a single assay. Further, multiple primers or probes may be used concurrently. The selection of tumor protein markers may be based on routine experiments to determine combinations that results in optimal sensitivity. In addition, or alternatively, assays for tumor proteins provided herein may be combined with assays for other known tumor antigens.

The present invention further provides kits for use within any of the above diagnostic methods. Such kits typically comprise two or more components necessary for performing a diagnostic assay. Components may be compounds, reagents, containers and/or equipment. For example, one container within a kit may contain a monoclonal antibody or fragment thereof that specifically binds to a tumor protein. Such antibodies or fragments may be provided attached to a support material, as described above. One or more additional containers may enclose elements, such as reagents or buffers, to be used in the assay. Such kits may also, or alternatively, contain a detection reagent as described above that contains a reporter group suitable for direct or indirect detection of antibody binding.

Alternatively, a kit may be designed to detect the level of mRNA encoding a tumor protein in a biological sample. Such kits generally comprise at least one oligonucleotide probe or primer, as described above, that hybridizes to a polynucleotide encoding a tumor protein. Such an oligonucleotide may be used, for example, within a PCR or hybridization assay. Additional components that may be present within such kits include a second oligonucleotide and/or a diagnostic reagent or container to facilitate the detection of a polynucleotide encoding a tumor protein.

The following Examples are offered by way of illustration and not by way of limitation.

EXAMPLE 1

Preparation of Lung Tumor-Spesific CDNA Sequences Using Differential Display RT-PCR This example illustrates the preparation of cDNA molecules encoding lung tumor-specific polypeptides using a differential display screen.

Tissue samples were prepared from lung tumor and normal tissue of a patient with lung cancer that was confirmed by pathology after removal of samples from the patient. Normal RNA and tumor RNA was extracted from the samples and mRNA was isolated and converted into cDNA using a $(dT)_{12}AG$ (SEQ ID NO: 47) anchored 3' primer. Differential display PCR was then executed using a randomly chosen primer (SEQ ID NO: 48). Amplification conditions were standard buffer containing 1.5 mM $MgCl_2$, 20 pmol of primer, 500 pmol dNTP and 1 unit of Taq DNA polymerase (Perkin-Elmer, Branchburg, N.J.). Forty cycles of amplification were performed using 94° C. denaturation for 30 seconds, 42° C. annealing for 1 minute and 72° C. extension for 30 seconds. Bands that were repeatedly observed to be specific to the RNA fingerprint pattern of the tumor were cut out of a silver stained gel, subcloned into the pGEM-T vector (Promega, Madison, Wis.) and sequenced. The isolated 3' sequences are provided in SEQ ID NO: 1–16.

Comparison of these sequences to those in the public databases using the BLASTN program, revealed no significant homologies to the sequences provided in SEQ ID NOs:1–11. To the best of the inventors' knowledge, none of the isolated DNA sequences have previously been shown to be expressed at a greater level in human lung tumor tissue than in normal lung tissue.

EXAMPLE 2

Use of Patient Sera to Identify DNA Sequences Encoding Lung Tumor Antigens

This example illustrates the isolation of cDNA sequences encoding lung tumor antigens by expression screening of lung tumor samples with autologous patient sera.

A human lung tumor directional cDNA expression library was constructed employing the Lambda ZAP Express expression system (Stratagene, La Jolla, Calif.). Total RNA for the library was taken from a late SCID mouse passaged human squamous epithelial lung carcinoma and poly A+ RNA was isolated using the Message Maker kit (Gibco BRL, Gaithersburg, Md.). The resulting library was screened using *E. coli*-absorbed autologous patient serum, as described in Sambrook et al., (*Molecular Cloning: A Laboratory Manual*, Cold Spring Harbor Laboratories, Cold Spring Harbor, N.Y., 1989), with the secondary antibody being goat anti-human IgG-A-M (H+L) conjugated with alkaline phosphatase, developed with NBT/BCIP (Gibco BRL). Positive plaques expressing immunoreactive antigens were purified. Phagemid from the plaques was rescued and the nucleotide sequences of the clones was determined.

Fifteen clones were isolated, referred to hereinafter as LT86-1–LT86-15. The isolated cDNA sequences for LT86-1–LT86-8 and LT86-10–LT86-15 are provided in SEQ ID NO: 17–24 and 26–31, respectively, with the corresponding predicted amino acid sequences being provided in SEQ ID NOs:32–39 and 41–46, respectively. The determined cDNA sequence for LT86-9 is provided in SEQ ID NO: 25, with the corresponding predicted amino acid sequences from the 3' and 5' ends being provided in SEQ ID NOs:40 and 65, respectively. These sequences were compared to those in the gene bank as described above. Clones LT86-3, LT86-6–LT86-9, LT86-11–LT86-13 and LT86-15 (SEQ ID NO: 19, 22–25, 27–29 and 31, respectively) were found to show some homology to previously identified expressed sequence tags (ESTs), with clones LT86-6, LT86-8, LT86-11, LT86-12 and LT86-15 appearing to be similar or identical to each other. Clone LT86-3 was found to show some homology with a human transcription repressor. Clones LT86-6, 8, 9, 11, 12 and 15 were found to show some homology to a yeast RNA Pol II transcription regulation mediator. Clone LT86-13 was found to show some homology with a *C. elegans* leucine aminopeptidase. Clone LT86-9 appears to contain two inserts, with the 5' sequence showing homology to the previously identified antisense sequence of interferon alpha-induced P27, and the 3' sequence being similar to LT86-6. Clone LT86-14 (SEQ ID NO: 30) was found to show some homology to the trithorax gene and has an "RGD" cell attachment sequence and a beta-Lactamase A site which functions in hydrolysis of penicillin. Clones LT86-1, LT86-2, LT86-4, LT86-5 and LT86-10 (SEQ ID NOs:17, 18, 20, 21 and 26, respectively) were found to show homology to previously identified genes. A subsequently determined extended cDNA sequence for LT86-4 is provided in SEQ ID NO: 66, with the corresponding predicted amino acid sequence being provided in SEQ ID NO: 67.

Subsequent studies led to the isolation of five additional clones, referred to as LT86-20, LT86-21, LT86-22, LT86-26 and LT86-27. The determined 5' cDN sequences for LT86-20, LT86-22, LT86-26 and LT86-27 are provided in SEQ ID NO: 68 and 70–72, respectively, with the determined 3' cDNA sequences for LT86-21 being provided in SEQ ID NO: 69. The corresponding predicted amino acid sequences for LT86-20, LT86-21, LT86-22, LT86-26 and LT86-27 are provided in SEQ ID NO: 73–77, respectively. LT86-22 and LT86-27 were found to be highly similar to each other. Comparison of these sequences to those in the gene bank as described above, revealed no significant homologies to LT86-22 and LT86-27. LT86-20, LT86-21 and LT86-26 were found to show homology to previously identified genes.

In further studies, a cDNA expression library was prepared using mRNA from a lung small cell carcinoma cell line in the lambda ZAP Express expression vector (Stratagene), and screened as described above, with a pool of two lung small cell carcinoma patient sera. The sera pool was adsorbed with *E. coli* lysate and human PBMC lysate was added to the serum to block antibody to proteins found in normal tissue. Seventy-three clones were isolated. The determined cDNA sequences of these clones are provided in SEQ ID NO: 290–362. The sequences of SEQ ID NO: 289–292, 294, 296–297, 300, 302, 303, 305, 307–315, 317–320, 322–325, 327–332, 334, 335, 338–341, 343–352, 354–358, 360 and 362 were found to show some homology to previously isolated genes. The sequences of SEQ ID NO: 293, 295, 298, 299, 301, 304, 306, 316, 321, 326, 333, 336, 337, 342, 353, 359 and 361 were found to show some homology to previously identified ESTs.

EXAMPLE 3

Use of Mouse Antisera to Identify DNA Sequences Encoding Lung Tumor Antigens

This example illustrates the isolation of cDNA sequences encoding lung tumor antigens by screening of lung tumor cDNA libraries with mouse anti-tumor sera.

A directional cDNA lung tumor expression library was prepared as described above in Example 2. Sera was obtained from SCID mice containing late passaged human squamous cell and adenocarcinoma tumors. These sera were pooled and injected into normal mice to produce anti-lung tumor serum. Approximately 200,000 PFUs were screened from the unamplified library using this antiserum. Using a goat anti-mouse IgG-A-M (H+L) alkaline phosphatase second antibody developed with NBT/BCIP (BRL Labs.), approximately 40 positive plaques were identified. Phage was purified and phagemid excised for 9 clones with inserts in a pBK-CMV vector for expression in prokaryotic or eukaryotic cells.

The determined cDNA sequences for 7 of the isolated clones (hereinafter referred to as L86S-3, L86S-12, L86S-16, L86S-25, L86S-36, L86S-40 and provided in SEQ ID NO: 49–55, with the corresponding predicted amino acid sequences being provided in SEQ ID NO: 56–62, respectively. The 5' cDNA sequences for the remaining 2 clones (hereinafter referred to as L86S-30 and L86S-41) are provided in SEQ ID NO: 63 and 64. L86S-36 and L86S-46 were subsequently determined to represent the same gene. Comparison of these sequences with those in the public database as described above, revealed no significant homologies to clones L86S-30, L86S-36 and L86S-46 (SEQ ID NO: 63, 53 and 55, respectively). L86S-16 (SEQ ID NO: 51) was found to show some homology to an EST previously identified in fetal lung and germ cell tumor. The remaining clones were found to show at least some degree of homology to previously identified human genes. Subsequently determined extended cDNA sequences for L86S-12, L86S-36 and L86S-46 are provided in SEQ ID NO: 78–80, respectively, with the corresponding predicted amino acid sequences being provided in SEQ ID NO: 81–83.

Subsequent studies led to the determination of 5' cDNA sequences for an additional nine clones, referred to as L86S-6, L86S-11, L86S-14, L86S-29, L86S-34, S-39, L86S-47, L86S-49 and L86S-51 (SEQ ID NO: 84–92, respectively). The corresponding predicted amino acid sequences are provided in SEQ ID NO: 93–101, respectively. L86S-30, L86S-39 and L86S-47 were found to be similar to each other. Comparison of these sequences with those in the gene bank as described above, revealed no significant homologies to L86S-14. L86S-29 was found to show some homology to a previously identified EST. L86S-6, L86S-11, L86S-34, L86S-39, L86S-47, L86S-49 and were found to show some homology to previously identified genes.

In further studies, a directional cDNA library was constructed using a Stratagene kit with a Lambda Zap Express vector. Total RNA for the library was isolated from two primary squamous lung tumors and poly A+ RNA was isolated using an oligo dT column. Antiserum was developed in normal mice using a pool of sera from three SCID mice implanted with human squamous lung carcinomas. Approximately 700,000 PFUs were screened from the unamplified library with *E. coli* absorbed mouse anti-SCID tumor serum. Positive plaques were identified as described above. Phage was purified and phagemid excised for 180 clones with inserts in a pBK-CMV vector for expression in prokaryotic or eukaryotic cells.

The determined cDNA sequences for 23 of the isolated clones are provided in SEQ ID NO: 126–148. Comparison of these sequences with those in the public database as described above revealed no significant homologies to the sequences of SEQ ID NO: 139 and 143–148. The sequences of SEQ ID NO: 126–138 and 140–142 were found to show homology to previously identified human polynucleotide sequences.

EXAMPLE 4

Use of Mouse Antisera to Screen Lung Tumor Libraries Prepared from Scid Mice

This example illustrates the isolation of cDNA sequences encoding lung tumor antigens by screening of lung tumor cDNA libraries prepared from SCID mice with mouse anti-tumor sera.

A directional cDNA lung tumor expression library was prepared using a Stratagene kit with a Lambda Zap Express vector. Total RNA for the library was taken from a late passaged lung adenocarcinoma grown in SCID mice. Poly A+ RNA was isolated using a Message Maker Kit (Gibco BRL). Sera was obtained from two SCID mice implanted with lung adenocarcinomas. These sera were pooled and injected into normal mice to produce anti-lung tumor serum. Approximately 700,000 PFUs were screened from the unamplified library with *E. coli*-absorbed mouse anti-SCID tumor serum. Positive plaques were identified with a goat anti-mouse IgG-A-M (H+L) alkaline phosphatase second antibody developed with NBT/BCIP (Gibco BRL). Phage was purified and phagemid excised for 100 clones with insert in a pBK-CMV vector for expression in prokaryotic or eukaryotic cells.

The determined 5′ cDNA sequences for 33 of the isolated clones are provided in SEQ ID NO: 149–181. The corresponding predicted amino acid sequences for SEQ ID NO: 149, 150, 152–154, 156–158 and 160–181 are provided in SEQ ID NO: 182, 183, 186, 188–193 and 194–215, respectively. The clone of SEQ ID NO: 151 (referred to as SAL-25) was found to contain two open reading frames (ORFs). The predicted amino acid sequences encoded by these ORFs are provided in SEQ ID NO: 184 and 185. The clone of SEQ ID NO: 153 (referred to as SAL-50) was found to contain two open reading frames encoding the predicted amino acid sequences of SEQ ID NO: 187 and 216. Similarly, the clone of SEQ ID NO: 155 (referred to as SAL-66) was found to contain two open reading frames encoding the predicted amino acid sequences of SEQ ID NO: 189 and 190. Comparison of the isolated sequences with those in the public database revealed no significant homologies to the sequences of SEQ ID NO: 151, 153 and 154. The sequences of SEQ ID NO: 149, 152, 156, 157 and 158 were found to show some homology to previously isolated expressed sequence tags (ESTs). The sequences of SEQ ID NO: 150, 155 and 159–181 were found to show homology to sequences previously identified in humans.

Using the procedures described above, two directional cDNA libraries (referred to as LT46-90 and LT86-21) were prepared from two late passaged lung squamous carcinomas grown in SCID mice and screened with sera obtained from SCID mice implanted with human squamous lung carcinomas. The determined cDNA sequences for the isolated clones are provided in SEQ ID NO: 217–237 and 286–289. SEQ ID NO: 286 was found to be a longer sequence of LT4690-71 (SEQ ID NO: 237). Comparison of these sequences with those in the public databases revealed no known homologies to the sequences of SEQ ID NO: 219, 220, 225, 226, 287 and 288. The sequences of SEQ ID NO: 218, 221, 222 and 224 were found to show some homology to previously identified sequences of unknown function. The sequence of SEQ ID NO: 236 was found to show homology to a known mouse mRNA sequence. The sequences of SEQ ID NO: 217, 223, 227–237, 286 and 289 showed some homology to known human DNA and/or RNA sequences.

In further studies using the techniques described above, one of the cDNA libraries described above (LT86-21) was screened with *E. coli*-absorbed mouse anti-SCID tumor serum. This serum was obtained from normal mice immunized with a pool of 3 sera taken from SCID mice implanted with human squamous lung carcinomas. The determined cDNA sequences for the isolated clones are provided in SEQ ID NO: 238–285. Comparison of these sequences with those in the public databases revealed no significant homologies to the sequences of SEQ ID NO: 253, 260, 277 and 285. The sequences of SEQ ID NO: 249, 250, 256, 266, 276 and 282 were found to show some homology to previously isolated expressed sequence tags (ESTs). The sequences of SEQ ID NO: 238–248, 251, 252, 254, 255, 257–259, 261–263, 265, 267–275, 278–281, 283 and 284 were found to show some homology to previously identified DNA or RNA sequences.

The expression levels of certain of the isolated antigens in lung tumor tissues compared to expression levels in normal tissues was determined by microarray technology. The results of these studies are shown below in Table 2, together with the databank analyses for these sequences.

TABLE 2

| Clone | SEQ ID NO: | Description | LT + F/N | SCC + M/N | Squa/ N | Adeno/ N |
|---|---|---|---|---|---|---|
| 2LT-3 | 238 | Unknown (KIAA0712) | 2.2 | 3.8 | 3.3 | — |
| 2LT-6 | 239 | Lactate DH B | 2.3 | 3.8 | 4.1 | — |
| 2LT-22 | 240 | Fumarate hydratase | — | 3.0 | — | — |
| 2LT-26 | 242 | CG1-39 | — | — | 12.8 | — |
| 2LT-31 | 243 | ADH7 | — | — | 8.4 | 2.2 |
| 2LT-36 | 244 | ADH7 | — | 2.4 | 2.0 | — |
| 2LT-42 | 245 | HMG-CoA synthase | 2.2 | 2.6 | 2.2 | — |
| 2LT-54 | 247 | (Mus) ninein | — | 2.1 | — | — |
| 2LT-55 | 248 | Ubiquitin | 2.2 | — | 2.5 | 2.0 |
| 2LT-57 | 249 | Novel | 2.1 | 2.9 | 2.4 | — |
| 2LT-58 | 250 | Novel | 2.3 | 4.0 | 2.9 | — |
| 2LT-59 | 251 | Unknown KIAA0784 | 2.4 | 3.0 | 2.3 | 2.0 |
| 2LT_62 | 252 | Nuc Pore Cmplx-ass pro TPR | — | — | — | 2.1 |
| 2LT-70 | 256 | Unknown KIAA0871 | — | 2.5 | 2.2 | 2.1 |
| 2LT-73 | 257 | Mus polyadenylate-binding | — | 2.0 | — | — |

TABLE 2-continued

| Clone | SEQ ID NO: | Description | LT + F/N | SCC + M/N | Squa/ N | Adeno/ N |
|---|---|---|---|---|---|---|
| 2LT-76 | 259 | Trans-Golgi p230 | 2.1 | — | 2.6 | — |
| 2LT-85 | 263 | Ribosomat protein (LS29) | — | — | — | 2.1 |
| 2LT-89 | 265 | Unknown PAC212G6 | — | 2.0 | — | — |
| 2LT-98 | 268 | Melanoma diff assoc pro 9 | — | — | — | 2.2 |
| 2LT-100 | 269 | Mus Collagen alpha VI | — | — | — | 2.1 |
| 2LT-105 | 271 | NY-CO-7 antigen | — | 3.2 | — | — |
| 2LT-108 | 273 | Unknown RG363M04 | — | 3.1 | — | — |
| 2LT-124 | 279 | Galectin-9 (secreted) | 2.3 | 2.7 | 2.0 | — |
| 2LT-126 | 280 | L1 element L1.33 p40 | 2.5 | — | 3.1 | — |
| 2LT-128 | 282 | Novel (kappa B-ras 2) | 2.3+ | — | 20.4 | 2.5 |
| 2LT-133 | 284 | Alpha II spectrin | — | 2.3 | — | — |

LT + F/N = Lung Tumor plus Fetal tissue over Normal tissues
SC + M/N = Lung Small Cell carcinoma plus Metastatic over Normal tissues
Squa/N = Squamous lung tumor over Normal tissues
Aden/N = Adenocarcinoma over Normal tissues Full-length sequencing studies on antigen 2LT-128 (SEQ ID NO: 282) resulted in the isolation of the full-length cDNA sequence provided in SEQ ID NO: 392. This amino acid sequence encoded by this full-length cDNA sequence is provided in SEQ ID NO: 393. This antigen shows 20-fold over-expression in squamous cell carcinoma and 2.5-fold over-expression in lung adenocarcinoma. This gene has been described as a potential ras oncogene (Fenwick et al. *Science*, 287:869–873, 2000).

Extended sequence information was obtained for clones 2LT-3 (SEQ ID NO: 238), 2LT-26 (SEQ ID NO: 242), 2LT-57 (SEQ ID NO: 249), 2LT-58 (SEQ ID NO: 250), 2LT-98 (SEQ ID NO: 268) and 2LT-124 (SEQ ID NO: 279). The extended cDNA sequences for these clones are set forth in SEQ ID NOs:428–433, respectively, encoding the polypeptide sequences set forth in SEQ ID NOs: 434–439, respectively.

EXAMPLE 5

Determination of Tissue Specificity of Lung Tumor Polypeptides

Using gene specific primers, mRNA expression levels for representative lung tumor polypeptides were examined in a variety of normal and tumor tissues using RT-PCR.

Briefly, total RNA was extracted from a variety of normal and tumor tissues using Trizol reagent. First strand synthesis was carried out using 2 µg of total RNA with SuperScript II reverse transcriptase (BRL Life Technologies) at 42° C. for one hour. The cDNA was then amplified by PCR with gene-specific primers. To ensure the semi-quantitative nature of the RT-PCR, β-actin was used as an internal control for each of the tissues examined. 1 µl of 1:30 dilution of cDNA was employed to enable the linear range amplification of the β-actin template and was sensitive enough to reflect the differences in the initial copy numbers. Using these conditions, the β-actin levels were determined for each reverse transcription reaction from each tissue. DNA contamination was minimized by DNase treatment and by assuring a negative PCR result when using first strand cDNA that was prepared without adding reverse transcriptase.

mRNA Expression levels were examined in five different types of tumor tissue (lung squamous tumor from 3 patients, lung adenocarcinoma, prostate tumor, colon tumor and lung tumor), and different normal tissues, including lung from four patients, prostate, brain, kidney, liver, ovary, skeletal muscle, skin, small intestine, myocardium, retina and testes. L86S-46 was found to be expressed at high levels in lung squamous tumor, colon tumor and prostate tumor, and was undetectable in the other tissues examined. L86S-5 was found to be expressed in the lung tumor samples and in 2 out of 4 normal lung samples, but not in the other normal or tumor tissues tested. L86S-16 was found to be expressed in all tissues except normal liver and normal stomach. Using real-time PCR, L86S-46 was found to be over-expressed in lung squamous tissue and normal tonsil, with expression being low or undetectable in all other tissues examined.

EXAMPLE 6

Isolation of DNA Sequences Encoding Lung Tumor Antigens

DNA sequences encoding antigens potentially involved in squamous cell lung tumor formation were isolated as follows.

A lung tumor directional cDNA expression library was constructed employing the Lambda ZAP Express expression system (Stratagene, La Jolla, Calif.). Total RNA for the library was taken from a pool of two human squamous epithelial lung carcinomas and poly A+ RNA was isolated using oligo-dT cellulose (Gibco BRL, Gaithersburg, Md.). Phagemid were rescued at random and the cDNA sequences of isolated clones were determined.

The determined cDNA sequence for the clone SLT-T1 is provided in SEQ ID NO: 102, with the determined 5' cDNA sequences for the clones SLT-T2, SLT-T3, SLT-T5, SLT-T7, SLT-T9, SLT-T10, SLT-T11 and SLT-T12 being provided in SEQ ID NO: 103–110, respectively. The corresponding predicted amino acid sequence for SLT-T1, SLT-T2, SLT-T3, SLT-T10 and SLT-T12 are provided in SEQ ID NO: 111–115, respectively. Comparison of the sequences for SLT-T2, SLT-T3, SLT-T5, SLT-T7, SLT-T9 and SLT-T11 with those in the public databases as described above, revealed no significant homologies. The sequences for SLT-T10 and SLT-T12 were found to show some homology to sequences previously identified in humans.

The sequence of SLT-T1 was determined to show some homology to a PAC clone of unknown protein function. The cDNA sequence of SLT-T1 (SEQ ID NO: 102) was found to contain a mutator (MUTT) domain. Such domains are known to function in removal of damaged guanine from DNA that can cause A to G transversions (see, for example, el-Deiry, W. S., 1997 *Curr. Opin. Oncol.* 9:79–87; Okamoto, K. et al. 1996 *Int. J. Cancer* 65:437–41; Wu, C. et al. 1995 *Biochem. Biophys. Res. Commun.* 214:1239–45; Porter, D. W. et al. 1996 *Chem. Res. Toxicol.* 9:1375–81). SLT-T1 may thus be of use in the treatment, by gene therapy, of lung cancers caused by, or associated with, a disruption in DNA repair.

In further studies, DNA sequences encoding antigens potentially involved in adenocarcinoma lung tumor formation were isolated as follows. A human lung tumor directional cDNA expression library was constructed employing the Lambda ZAP Express expression system (Stratagene, La Jolla, Calif.). Total RNA for the library was taken from a late SCID mouse passaged human adenocarcinoma and poly A+ RNA was isolated using the Message Maker kit (Gibco BRL, Gaithersburg, Md.). Phagemid were rescued at random and the cDNA sequences of isolated clones were determined.

The determined 5' cDNA sequences for five isolated clones (referred to as SALT-T3, SALT-T4, SALT-T7, SALT-T8, and SALT-T9) are provided in SEQ ID NO: 116–120, with the corresponding predicted amino acid sequences being provided in SEQ ID NO: 121–125. SALT-T3 was found to show 98% identity to the previously identified human transducin-like enhancer protein TLE2. SALT-T4 appears to be the human homologue of the mouse H beta 58 gene. SALT-T7 was found to have 97% identity to human 3-mercaptopyruvate sulfurtransferase and SALT-T8 was found to show homology to human interferon-inducible protein 1–8U. SALT-T9 shows approximately 90% identity to human mucin MUC 5B.

cDNA sequences encoding antigens potentially involved in small cell lung carcinoma development were isolated as follows. cDNA expression libraries were constructed with mRNA from the small cell lung carcinoma cell lines NCIH69, NCIH128 and DMS79 (all available from the American Type Culture Collection, Manassas, Va.) employing the Lambda ZAP Express expression system (Stratagene, La Jolla, Calif.). Phagemid were rescued at random and the cDNA sequences of 27 isolated clones were determined. Comparison of the determined cDNA sequences revealed no significant homologies to the sequences of SEQ ID NO: 372 and 373. The sequences of SEQ ID NO: 364, 369, 377, 379 and 386 showed some homology to previously isolated ESTs. The sequences of the remaining 20 clones showed some homology to previously identified genes. The cDNA sequences of these clones are provided in SEQ ID NO: 363, 365–368, 370, 371, 374–376, 378, 380–385 and 387–389, wherein SEQ ID NO: 363, 366–368, 370, 375, 376, 378, 380–382, 384 and 385 are full-length sequences.

Comparison of the cDNA sequence of SEQ ID NO: 372 indicated that this clone (referred to as 128T1) is a novel member of a family of putative seven pass transmembrane proteins. Specifically, using the computer algorithm PSORT, the protein was predicted to be a type IIIA plasma membrane seven pass transmembrane protein. A genomic clone was identified in the Genbank database which contained the predicted N-terminal 58 amino acids missing from the amino acid sequence encoded by SEQ ID NO: 372. The determined full-length cDNA sequence for the 128T1 clone is provided in SEQ ID NO: 390, with the corresponding amino acid sequence being provided in SEQ ID NO: 391.

The expression levels of certain of the isolated antigens in lung tumor tissues compared to expression levels in normal tissues was determined by microarray technology. The results of these studies are shown below in Table 3, together with the databank analyses for these sequences.

TABLE 3

| Clone | SEQ ID NO: | Description | LT + F/N | SCC + M/N | Squa/ N | Adeno/ N |
|---|---|---|---|---|---|---|
| DMS79-T1 | 363 | STAT-ind inhib of cytokine | — | 2.0 | — | — |
| DMS79-T6 | 367 | Neuronal cell death related | — | 2.2 | — | — |
| DMS79-T9 | 369 | Novel | — | 2.2 | — | — |
| DMS79-T10 | 370 | Ubiquitin carrier protein | — | 3.9 | 2.2 | — |
| DMS79-T11 | 371 | HPV16E1 pro binding protein | — | 2.1 | — | — |

TABLE 3-continued

| Clone | SEQ ID NO: | Description | LT + F/N | SCC + M/N | Squa/ N | Adeno/ N |
|---|---|---|---|---|---|---|
| 128-T9 | 378 | Elongation factor 1 alpha | — | 2.7 | — | — |
| 128T11 | 380 | Malate dehyrogenase | — | 2.3 | 2.0 | — |
| 128-T12 | 381 | Apurinic/ apyrim endonuclease | — | 5.4 | — | — |
| NCIH69-T3 | 382 | Sm-like protein CaSm | — | — | 2.4 | — |
| NCIH69-T6 | 384 | Transcription factor BTF3a | — | 2.5 | — | — |

LT + F/N = Lung Tumor plus Fetal tissue over Normal tissues
SC + M/N = Lung Small Cell carcinoma plus Metastatic over Normal tissues
Squa/N = Squamous lung tumor over Normal tissues
Aden/N = Adenocarcinoma over Normal tissues

EXAMPLE 7

Synthesis of Polypeptides

Polypeptides may be synthesized on a Perkin Elmer/Applied Biosystems Division 430A peptide synthesizer using FMOC chemistry with HPTU (O-Benzotriazole-N,N,N',N'-tetramethyluronium hexafluorophosphate) activation. A Gly-Cys-Gly sequence may be attached to the amino terminus of the peptide to provide a method of conjugation, binding to an immobilized surface, or labeling of the peptide. Cleavage of the peptides from the solid support may be carried out using the following cleavage mixture: trifluoroacetic acid:ethanedithiol:thioanisole:water:phenol (40:1:2:2:3). After cleaving for 2 hours, the peptides may be precipitated in cold methyl-t-butyl-ether. The peptide pellets may then be dissolved in water containing 0.1% trifluoroacetic acid (TFA) and lyophilized prior to purification by C18 reverse phase HPLC. A gradient of 0%–60% acetonitrile (containing 0.1% TFA) in water (containing 0.1% TFA) may be used to elute the peptides. Following lyophilization of the pure fractions, the peptides may be characterized using electrospray or other types of mass spectrometry and by amino acid analysis.

EXAMPLE 8

Isolation and Characterization of DNA Sequences Encoding Lung Tumor Antigens by T-Cell Expression Cloning Lung tumor antigens may also be identified by T cell expression cloning. One source of tumor specific T cells is from surgically excised tumors from human patients.

A non-small cell lung carcinoma was minced and enzymatically digested for several hours to release tumor cells and infiltrating lymphocytes (tumor infiltrating T cells, or TILs). The cells were washed in HBSS buffer and passed over a Ficoll (100%/75%/HBSS) discontinuous gradient to separate tumor cells and lymphocytes from non-viable cells. Two bands were harvested from the interfaces; the upper band at the 75%/HBSS interface contained predominantly tumor cells, while the lower band at the 100%/75%/HBSS interface contained a majority of lymphocytes. The TILs were expanded in culture, either in 24-well plates with culture media supplemented with 10 ng/ml IL-7 and 100 U/ml IL-2, or alternatively, 24-well plates that have been pre-coated with the anti-CD3 monoclonal antibody OKT3. The resulting TIL cultures were analyzed by FACS to confirm that a high percentage were CD8+ T cells (>90% of gated population) with only a small percentage of CD4+ cells.

In addition, non-small cell lung carcinoma cells were expanded in culture using standard techniques to establish a tumor cell line (referred to as LT391-06), which was later confirmed to be a lung carcinoma cell line by immunohistochemical analysis. This tumor cell line was transduced with a retroviral vector to express human CD80, and characterized by FACS analysis to confirm high expression levels of CD80, class I MHC and class II MHC molecules.

The ability of the TIL lines to specifically recognize autologous lung tumor was demonstrated by cytokine release assays (IFN-γ and TNF-α) as well as $^{51}$Cr release assays. Briefly, TIL cells from day 21 cultures were co-cultured with either autologous or allogeneic tumor cells, EBV-immortalized LCL, or control cell lines Daudi and K562, and the culture supernatant monitored by ELISA for the presence of cytokines. The TIL specifically recognized autologous tumor but not allogeneic tumor. In addition, there was no recognition of EBV-immortalized LCL or the control cell lines, indicating that the TIL lines are tumor specific and are potentially recognizing a tumor antigen presented by autologous MHC molecules.

The characterized tumor-specific TIL lines were expanded to suitable numbers for T cell expression cloning using soluble anti-CD3 antibody in culture with irradiated EBV transformed LCLs and PBL feeder cells in the presence of 20 U/ml IL-2. Clones from the expanded TIL lines were generated by standard limiting dilution techniques. Specifically, TIL cells were seeded at 0.5 cells/well in a 96-well U bottom plate and stimulated with CD-80-transduced autologous tumor cells, EBV transformed LCL, and PBL feeder cells in the presence of 50 U/ml IL-2. The specificity of these clones for autologous tumor was confirmed by $^{51}$Cr microcytotoxicity and IFN-γ bioassays.

These CTL clones were demonstrated to be HLA-B/C restricted by antibody blocking experiments. A representative CTL clone was tested on a panel of allogeneic lung carcinomas and it recognized both autologous tumor and a lung squamous cell carcinoma (936T). As the only class I MHC molecule shared among these tumors was HLA-Cw1203, this indicated that this was the restriction element used by the CTL. This finding was confirmed by the recognition of a number of allogeneic lung carcinomas transduced with a retroviral vector encoding HLA-Cw1203 by the CTL.

PolyA mRNA was prepared from a lung tumor cell line referred to as LT391-06 using Message Maker (Life Technologies; Rockville, Md.). The subsequent steps involving cDNA synthesis were performed according to Life Technologies cloning manual (SuperScript Plasmid System for cDNA Synthesis and Plasmid Cloning). Modifications to the protocol were made as follows. At the adapter addition step, EcoRI-XmnI adapters (New England Biolabs; Beverly, Mass.) were substituted. Size fractionated cDNAs were ligated into the expression vector system HisMax A, B, C (Invitrogen; Carlsbad, Calif.) to optimize for protein expression in all three coding frames. Library plasmids were then aliquotted at approximately 100 CFU/well into a 96-well block for overnight liquid amplification. From these cultures, glycerol stocks were made and pooled plasmid was prepared by automated robot (Qiagen; Valencia, Calif.). The concentration of the plasmid DNA in each well of the library plates was determined to be approximately 150 ng/ul. Initial characterization of the cDNA expression library was performed by randomly sequencing 24 primary transformants and subjecting the resulting sequences to BLAST searches against available databases. The determined cDNA sequences are provided in SEQ ID NO: 443–480, with the results of the BLAST searches being provided in Table 4.

TABLE 4

| Clone | SEQ ID NO: | GenBank Accession | Description |
|---|---|---|---|
| 55163 | 458, 459 | | Novel in Genbank |
| 55158 | 452 | | Novel in Genbank |
| Homology to known sequences with unknown function | | | |
| 55153 | 443, 444 | 7018516 | H. sapiens mRNA; cDNA DKFZp434M035 |
| 55154 | 445, 446 | 6437562 | H. sapiens Chr 22q11 PAC Clone p393 |
| 55157 | 450, 451 | 2887408 | H. sapiens KIAA0417 mRNA |
| 55165 | 462, 463 | 3970871 | H. sapiens HRIHFB2122 mRNA |
| Homology to known sequences with known function | | | |
| 55155 | 447 | 7677405 | H. sapiens F-box protein FBS (FBS) |
| 55156 | 448, 449 | 3929584 | H. sapiens EEN pseudogene |
| 55161 | 454, 455 | 4503350 | H. sapiens DNA (cytosine-5-)-methyltransferase 1 (DNMT1) |
| 55162 | 456, 457 | 31220 | ERK1 mRNA for protein serine/threonine kinase |
| 55164 | 460, 461 | 6677666 | H. sapiens RNA-binding protein (autoantigenic) (RALY) |
| 55166 | 464, 465 | 3249540 | H. sapiens ribonuclease P protein subunit p40 (RPP40) |
| 55167 | 466, 467 | 7657497 | H. sapiens renal tumor antigen (RAGE) |
| 55168 | 468, 469 | 2873376 | H. sapiens exportin t mRNA |
| 55169 | 470, 471 | 3135472 | H. sapiens Cre binding protein-like 2 mRNA |
| 55171 | 474 | 4759151 | H. sapiens spermine synthase (SMS) |
| 55173 | 476 | 6688148 | H. sapiens partial mRNA for NICE-3 protein |
| 55174 | 477, 478 | 531394 | Human transcriptional coactivator PC4 |
| 55175 | 479 | 6563201 | H. sapiens translation initiation factor eIF-2b delta subunit |
| 55176 | 480 | 29860 | hCENP-Bgene, for centromere autoantigen B (CENP-B) |
| Homology to Ribosomal Protein | | | |
| 55159 | 453 | 337494 | Ribosomal protein L7a (surf 3) large subunit mRNA |
| 55170 | 472, 473 | 4506648 | H. sapiens mRNA for ribosomal protein L3 |
| 55172 | 475 | 388031 | H. sapiens ribosomal rotein L11 |

For T cell screening, approximately 80 ng of the library plasmid DNA and 80 ng of HLA-Cw1203 plasmid DNA was mixed with the lipid Fugene according to the manufacturers' instructions and transfected in duplicate into COS-7 cells. After incubation at 37° C. for 48 hours, the transfection mixture was removed and 10,000 LT391-06 CTL were added to each well in fresh media containing human serum.

The ability of T cells to recognize an antigen in the library was assessed by cytokine release after 6 hours (TNF-alpha, WEHI bio-assay) or after 24 hours (IFN-gamma, ELISA). Approximately 2.0×10$^5$ clones (in plasmid pools of 100) were screened using this system in COS-7 cells. Three plasmid pools were identified (referred to as 14F10, 19A4, and 20E10) that were recognized by LT391-06 CTL. Transfection of these plasmid pools into COS-7 cells led to production of both IFN-gamma and TNF-alpha from the LT391-06 CTL at levels significantly above background. Pools 14F10, 19A4 and 20E10 were "broken down" into several hundred individual plasmid DNAs and retested. The sequences of 24 novel clones isolated from pool 14F10 are provided in SEQ ID NO: 481–511.

One plasmid (3D9) from pool 14F10, one plasmid from pool 20E10 and 5 plasmids (2A6, 2E11, 2F12, 3F4, 3H8) from pool 19A4 were capable of reconstituting T cell recognition. Sequencing of these plasmids led to the identification of a 7.8 kB cDNA insert (referred to as clone 14F10), a 2.2 kB cDNA insert (referred to as clone 19A4; SEQ ID NO: 440), and a clone referred to as 20E10. The full-length cDNA sequence for 14F10 is provided in SEQ ID NO: 441. Clone 14F10 does not contain the first two "G" nucleotides found at the 5' end of 19A4, and the 3'-proximal 24 bp of 19A4 differ from the corresponding region of 14F10 (nucleotides 2145–2165). Furthermore, 3837 bp of 3' additional sequence was isolated for clone 14F10. The 5' terminal cDNA sequence (337 bp) of clone 20E10 is provided in SEQ ID NO: 442. 20E10 contains an additional 3 nucleotides (as compared to 19A4) at the 5'-most end. The additional sequence from the 5' end of clone 20E10 contains an "ATG" and therefore appears to contain the translational start site of a novel open reading frame. BLAST search analysis against the GenBank database identified these sequences as having significant homology with a truncated human cystine/glutamate transporter gene. Unlike the published sequence, however, clones 14F10 and 19A4 contain a unique 5' terminus consisting of 181 nucleotides. This novel sequence replaces the published 5' region and results in the removal of the reported initiating methionine (start codon) and an additional two amino acids of the reported transporter protein. Therefore, the translated product of clones 14F10 and 19A4 is different than the cystine/glutamate transporter protein. Furthermore, T cell recognition of other lung tumors demonstrates that this antigen is expressed by other tumors as well.

The epitope and amino acid sequence encoded within clones 19A4 and 14F10 which reconstitutes T cell recognition of anti-LT391-06 cells were mapped as follows. Cos-7 cells were transfected with 80 ng/well HLA-Cw1203 along with titrated amounts of cDNA encoding clone 19A4, a potential open reading frame located in the unique 5' terminus of 19A4, or the open reading frame from the cystine/glutamate (Cys-Glu) transporter gene, cloned into a eukaryotic expression vector and tested for stimulation of anti-LT391-06 T cells in a TNF assay. As a positive control Cos-7 cells were co-transfected with HLA-Cw1203 and the positive plasmid clone 19A4 described above. The Cys-Glu transporter expression construct was isolated by PCR using 5' and 3' primers specific for the known ORF of the transporter with 19A4 as template. In addition, each 5' primer contained a Kozak translation initiation site and starting methionine to drive translation of the polypeptide. CTL against LT391-06 did not recognize transfectants expressing the Cys-Glu transporter construct, but did recognize transfectants expressing 19A4 and the 5' ORF from 19A4.

In subsequent experiments, Cos-7 cells were co-transfected with 80 ng/well HLA-Cw1203 along with titrated amounts of DNA of transposition mutants F10 and C12, respectively, and tested for simulation of anti-LT391-06 T cells in a TNF assay. As a positive control, Cos-7 cells were co-transfected with HLA-Cw1203 and clones of the 5' ORF of 19A4. Transposition mutants F10 and C12 were obtained by transposon-mediated mutation of the 14F10 clone and screening for insertion site by sequence analyses.

The transposon of mutant F10 is inserted approximately 304 bp from the 5' EcoRI cloning site of the 14F10 cDNA. This mutation did not disrupt translation of the T cell epitope. By contrast, the transposon of mutant C12, which is inserted approximately 116 bp from the 5' EcoRI cloning site of the 14F10 cDNA, was found to interrupt translation of the T cell eptiope. Thus the epitope in 14F10 maps between these two transposon insertion sites. The amino acid sequence of the region between the C12 and F 10 transposon insertion sites is provided in SEQ ID NO: 586.

A series of 11 overlapping 16-mer and 15-mer peptides for the region shown in SEQ ID NO: 586 were prepared and tested for stimulation of anti-LT391-06 cells, as determined by cytokine release in TNF and IFN-$\gamma$ assays. Only the peptide provided in SEQ ID NO: 587 (corresponding to residues 5–20 of SEQ ID NO: 586) stimulated cytokine release. These studies demonstrate that the HLA-Cw1203 restricted epitope of the LT391-06 antigen is contained within SEQ ID NO: 587.

EXAMPLE 9

Isolation and Characterization of DNA Sequences Encoding Lung Tumor Antigens by PCR Subtraction This example describes the isolation and characterization of cDNA clones from a PCR subtracted expression library prepared from the human lung tumor cell line LT391-06 described above.

Tester poly A mRNA was prepared from the cell line LT391-06 as described above. Driver poly A mRNA was isolated from a human acute T cell leukemia/T lymphocyte cell line (Jurkat) which is derived from non-lung cells and is not recognized by LT391-06 reactive T cells. The subtraction was performed according to the method of Clontech (Palo Alto, Calif.) with the following changes: 1) a second restriction digestion reaction of cDNA was completed using a pool of enzymes (MscI, PvuII, StuI and DraI). This was in addition to, and separate from, the Clontech recommended single restriction enzyme digestion with RsaI. Each restriction digest set was treated as a separate library to ensure that the final mixed library contained overlapping fragments. Thus, the epitope recognized by the T cells should be represented on a fragment within the library and not destroyed by the presence of a single restriction site within it. 2) The ratio of driver to tester cDNA was increased in the hybridization steps to increase subtraction stringency. To analyze the efficiency of the subtraction, actin was PCR amplified from dilutions of subtracted, as well as unsubtracted, PCR samples. The second amplification step utilized primers that were modified from those normally used. Three nested PCR primers were engineered to contain a cleavable EcoRI site (not utilized during cloning) that was in one of three frames. Thus, secondary amplification with these primers resulted in products that could be ligated directly into the eukaryotic expression plasmid pcDNA4His/Max-Topo (Invitrogen). This resulted in the PCR subtracted and amplified fragments being represented in-frame somewhere within the library. Due to the mechanics of the subtraction only 50% of fragments will be in the correct orientation. The complexity and redundancy of the library was characterized by sequencing 96 randomly picked clones from the final pooled PCR subtraction expression library, referred to as LT391-06PCR. These (SEQ ID NO: 512–581) were analyzed by comparison to sequences in publicly available databases (Table 5).

TABLE 5

| Clone | SEQ ID NO: | GenBank Accession | Description |
|---|---|---|---|
| 57235 | 532 | | Novel in Genbank |
| 57255 | 547 | | Novel in Genbank |
| 57264 | 554 | | Novel in Genbank |
| Homology to known sequences with unknown function | | | |
| 57215 | 518 | 5689540 | H. sapiens mRNA for KIAA1102 protein |
| 57223 | 522 | 2341006 | Human Xg13 3' end of PAC 92E23 |
| 57227 | 524 | 7022540 | H. sapiens cDNA FLJ10480 fis, clone NT2RP2000126 |
| 57238 | 535 | 6807795 | H. sapiens mRNA; cDNA DKFZp761G02121 |
| 57239 | 536 | 5757546 | H. sapiens clone DJ0823F17 |
| 57243 | 539 | 7023805 | H. sapiens cDNA FLJ11259 fis, clone PLACE 1009045 |
| 57245 | 540 | 4884472 | H. sapiens mRNA; cDNA DKFZp586O2223 |
| 57267 | 557 | 6808218 | H. sapiens mRNA; cDNA DKFZp434O1519 |
| 57268 | 558 | 10040400 | Sequence 12 from Patent WO9954460 |
| 57270 | 560 | 7959775 | H. sapiens PRO1489 mRNA |
| 57271 | 561 | 4500158 | H. sapiens mRNA; cDNA DKFZp586B0918 |
| 57281 | 567 | 6560920 | H. sapiens clone RP11-501O7 |
| 57283 | 569 | 285962 | Human mRNA for KIAA0108 gene |
| 57285 | 570 | 7019813 | H. sapiens cDNA FLJ20002 fis, clone ADKA01577 |
| Homology to known sequences with known function | | | |
| 57207 | 512 | 517176 | H. sapiens YAP65 mRNA |
| 57210 | 514 | 6841233 | H. sapiens HSPC292 mRNA |
| 57211 | 515 | 2606093 | H. sapiens Cyr61 protein (CYR61) mRNA |
| 57212 | 516 | 339648 | Human thioredoxin (TXN) mRNA |
| 57219 | 519 | 4504616 | H. sapiens insulin-like growth factor binding protein 3 (IGFBP3) |
| 57221 | 520 | 7274241 | H. sapiens novel retinal pigment epithelial cell protein (NORPEG) |
| 57222 | 521 | 189564 | Human, plasminogen activator inhibitor-1 gene |
| 57228 | 525 | 4757755 | H. sapiens annexin A2 ANXA2 |
| 57230 | 527 | 180800 | Human alpha-1 collagen type IV gene, exon 52 |
| 57232 | 529 | 6729061 | H. sapiens clone RPC11-98D12 from 7q31 |
| 57233 | 530 | 338391 | Spermidine/spermine N1-acetyltransferase |
| 57234 | 531 | 7305302 | H. sapiens NCK-associated protein 1 (NCKAP1) |
| 57236 | 533 | 4929722 | H. sapiens CGI-127 protein |
| 57242 | 538 | 4503558 | H. sapiens epithelial membrane protein 1 (EMP1) |
| 57248 | 541 | 183585 | Human pregnancy-specific beta-glycoprotein c |
| 57250 | 543 | 4759283 | H. sapiens ubiquitin carboxyl-terminal esterase L1 (UCHL1) |
| 57251 | 544 | 1236321 | Human laminin gamma2 chain gene (LAMC2) |
| 57253 | 545 | 213831 | H. sapiens lysyl hydroxylase isoform 2 (PLOD2) |
| 57254 | 546 | 536897 | Human follistatin-related protein precursor mRNA |
| 57257 | 548 | 339656 | Human endothelial cell thrombomodulin |
| 57258 | 549 | 190467 | Human prion protein (PrP) mRNA |
| 57261 | 551 | 338031 | Human serglycin gene |
| 57262 | 552 | 178430 | Human alphoid DNA (alphoid repetitive sequence) |
| 57265 | 555 | 4502562 | H. sapiens calpain, large polypeptide L2 (CAPN2) |
| 57266 | 556 | 398163 | H. sapiens mRNA for insulin-like growth factor binding protein-3 |
| 57269 | 559 | 7262375 | H. carboxylesterase 2 (intestine, liver) (CES2) |
| 57272 | 562 | 467560 | H. sapiens mRNA for cysteine dioxygenase type 1 |
| 57274 | 563 | 482664 | H. sapiens annexin A3 (ANXA3) |
| 57275 | 564 | 2281904 | H. sapiens Brutonp's tyr. kinase (BTK), alpha-D-galactosidase A (GLA) |
| 57277 | 565 | 4557498 | H. sapiens C-terminal binding protein 2 (CTBP2) |
| 57282 | 568 | 189245 | Human,NAD(P)H:menadione oxidoreductase mRNA |
| 57287 | 571 | 28525 | Human mRNA for amyloid A4 precursor of Alzheimer's disease |
| 57288 | 572 | 4757755 | H. sapiens annexin A2 (ANXA2) |
| 57289 | 573 | 5729841 | H. sapiens glyoxalase I (GLO1) mRNA |
| 57290 | 574 | 6103642 | H. sapiens F-box protein FBX3 mRNA |
| 57295 | 576 | 182513 | Human ferritin L chain mRNA |
| 57299 | 579 | 37137 | Human mRNA for thrombospondin |
| 57301 | 580 | 179682 | Human (clone A12) C4b-binding protein beta-chain |
| 57302 | 581 | 6042205 | H. sapiens membrane metallo-endopeptidase (neutral endopeptidase, enkephalinase, CALLA, CD10) (MME) |
| 57213 | 517 | 2665791 | H. sapiens caveolin-2 mRNA |
| 57259 | 550 | 2665791 | H. sapiens caveolin-2 mRNA |
| 57225 | 523 | 179765 | Human calcyclin gene |
| 57229 | 526 | 179765 | Human calcyclin gene |
| 57237 | 534 | 186962 | Human laminin B2 chain gene |
| 57249 | 542 | 186962 | Human laminin B2 chain gene |
| 57231 | 528 | 4972626 | H. sapiens caveolin 1 (CAV1) gene |
| 57296 | 577 | 4972626 | H. sapiens caveolin 1 (CAV1) gene |
| 57297 | 578 | 4972626 | H. sapiens caveolin 1 (CAV1) gene |
| 57240 | 537 | 266237 | insulin-like growth factor binding protein 3 |
| 57292 | 575 | 184522 | Human insulin-like growth factor-binding protein-3 gene |
| 57263 | 553 | 4504618 | H. sapiens insulin-like growth factor binding protein 7 (IGFBP7) |
| 57280 | 566 | 4504618 | H. sapiens insulin-like growth factor binding protein 7 (IGFBP7) |
| Homology to Ribosomal Protein | | | |
| 57209 | 513 | 337504 | Human ribosomal protein S24 mRNA |

EXAMPLE 10

Isolation and Characterization of T Cell Receptors from T Cell Clones Specific for Lung Tumor Antigens This example describes the cloning and sequencing of T cell receptor (TCR) alpha and beta chains from a CD8 T cell clone specific for an antigen expressed by the lung tumor cell line LT391-06. T cells have a limited lifespan. Cloning of TCR chains and subsequent transfer would essentially enable infinite propagation of the T cell specificity. Cloning of tumor antigen TCR chains allows the transfer of the specificity into T cells isolated from patients that share TCR MHC-restricting alleles. Such T cells can then be expanded and used in adoptive transfer techniques to introduce the tumor antigen specificity into patients carrying tumors that express the antigen (see, for example, Clay et al. *J. Immunol.* 163:507 (1999)).

Cytotoxic T lymphocyte (CTL) clones specific for the lung tumor cell line LT391-06 were generated. Total mRNA from $2 \times 10^6$ cells from 15 such clones was isolated using Trizol reagent and cDNA was synthesized using Ready-to-Go kits (Pharmacia). To determine Va and Vb sequences in these clones, a panel of Va and Vb subtype-specific primers was synthesized and used in RT-PCR reactions with cDNA generated from each of the clones. The RT-PCR reactions demonstrated that each of the clones expressed a common Vb sequence that corresponded to the Vb13 subfamily. Using cDNA generated from one of the clones (referred to as 1105), the Va sequence expressed was determined to be Va22. To clone the full TCR alpha and beta chains from clone 1105, primers were designed that spanned the initiator and terminator-coding TCR nucleotides. Standard 35-cycle RT-PCR reactions were established using cDNA synthesized from the CTL clone and the primers, with PWO (BMB) as the thermostable polymerase. The resultant specific bands (approximately 850 bp for the alpha chain and approximately 950 bp for the beta chain) were ligated into the PCR blunt vector (Invitrogen) and transformed into *E. coli*. *E. coli* transformed with plasmids containing the full-length alpha and beta chains were identified, and large scale preparations of the corresponding plasmids were generated. Plasmids containing full-length TCR alpha and beta chains were sequenced. The determined cDNA sequences for the alpha and beta chains are provided in SEQ ID NO: 583 and 582, respectively, with the corresponding amino acid sequences being provided in SEQ ID NO: 584 and 585, respectively.

EXAMPLE 11

Cloning of cDNAs Encoding Lung Small Cell Carcinoma Antigens

Lung small cell carcinoma antigens were cloned by screening a small cell cDNA expression library with a mouse anti-SCID mouse serum. This antiserum was developed by growing lung small cell carcinoma cell lines NCIH69 and NCIH128 in SCID mice, removing SCID serum containing shed and secreted tumor antigens and immunizing normal mice with this serum. The library was constructed with mRNA from cell line NCIH128 in the lambda ZAP Express expression vector (Stratagene). The antiserum was adsorbed with *E. coli* lysate and human GAPDH protein and Ku autoantigens, and human PBMC lysate was added to the serum to block antibody to proteins found in normal tissue.

Sixty clones were isolated and the inserts of these clones were sequenced. The isolated clones and their respective sequence and clone identifiers are presented in Tables 6 and 7. The isolated clone sequences were compared to sequences in publically available databases. A summary of the Genbank homologies is found in Tables 6 and 7. Those showing some degree of similarity with known sequences are described in Table 6, while showing little or no similarity with known sequences are described in Table 7.

TABLE 6

| SEQ ID NO:. | CLONE ID# | Genbank Homologies |
|---|---|---|
| 589 | 54534 | *Homo sapiens* mRNA for LAK-1 |
| 590 | 54536 | *Homo sapiens* CGI-108 protein mRNA |
| 591 | 54538 | Human mRNA for HHR23A protein |
| 592 | 54540 | *Homo sapiens* chromosome 17, clone hRPC.1030_0_14 |
| 593 | 55084 | *Homo sapiens* homolog of rat elongation factor p18 (p18) |
| 594 | 55086 | Homo sapiens HSPC194 mRNA |
| 595 | 54555 | *Homo sapiens* accessory proteins BAP31/BAP29 (DXS1357E)mRNA |
| 596 | 54557 | *Homo sapiens* mesenchymal stem cell protein DSCD75 mRNA |
| 597 | 54564 | *Homo sapiens* prp28, U5 snRNP 100 kd protein (US-100K) mRNA |
| 599 | 55473 | *Homo sapiens* uroporphyrinogen III synthase (congenital erythropoietic porphyria) (UROS |
| 600 | 55104 | *Homo sapiens* carbonyl reductase (LOC51181) |
| 601 | 55105 | *Homo sapiens* membrane component, chromosome 11, surface marker 1 (M11S1) |
| 602 | 55107 | *H. sapiens* mRNA encoding GPI-anchored protein p137 |
| 604 | 55114 | *Homo sapiens* mRNA; cDNA DKFZp56401716 |
| 605 | 55477 | *H. sapiens* YB-1 gene promoter region |
| 606 | 55482 | *Homo sapiens* mRNA; cDNA DKFZp434B0425 |
| 607 | 55483 | Human Gu protein mRNA |
| 608 | 55485 | *Homo sapiens* 45kDa splicing factor mRNA |
| 609 | 55487 | *Homo sapiens* genomic DNA, chromosome 21q, section 72/105 |
| 610 | 55488 | *Homo sapiens* chromosome 17, clone hCIT529110 |
| 612 | 55089 | *Homo sapiens* scaffold attachment factor A (SAF-A) mRNA |
| 613 | 55092 | *Homo sapiens* density regulated protein drp1 mRNA |
| 614 | 55093 | *H. sapiens* mRNA encoding GPI-anchored protein p137 |
| 615 | 56926 | *Homo sapiens* high-mobility group (nonhistone chromosomal) protein 17 (HMG17) |
| 617 | 56944 | *Homo sapiens* KBNA-2 co-activator (100kD) (p100), mRNA |
| 619 | 55490 | *Homo sapiens* death-associated protein 6 (DAXX) mRNA, and translated products. |
| 620 | 55495 | *Homo sapiens* mRNA for MEGF6 |
| 621 | 55504 | *Mus musculus* hairy/enhancer of split 6 mRNA |
| 624 | 56482 | *H. sapiens* DNA from chromosome 19-cosmids R31158, R31874, & R28125, genomic seq. |
| 626 | 56487 | Human L23 mRNA for putative ribosomal protein |
| 627 | 56488 | *Homo sapiens* cDNA FLJ10526 fis, clone NT2RP2000931, highly similar to MATRIN 3 |
| 628 | 56490 | *Homo sapiens* Sul1 isolog mRNA |
| 630 | 56494 | *Homo sapiens* mRNA; cDNA DKFZpS64B167 (from clone DKFZp564B167) |
| 631 | 56495 | *Homo sapiens* 12p13.3 BAG RPC11-543P15 (Roswell Park Cancer Inst. Human BAG lib.) |
| 632 | 56499 | Human DNA-binding protein B (dbpB) gene, 3' end |
| 633 | 56517 | *Homo sapiens* esterase D mRNA |
| 634 | 56952 | *Homo sapiens* 14q32 Jagged2 gene, complete cds; and unknown gene |
| 635 | 56953 | *Homo sapiens* DNA polymerase zeta catalytic subunit (REV3L)mRNA |
| 637 | 57139 | *Homo sapiens* ribosomal protein, large, PO (RPLPO) mRNA |
| 638 | 57078 | *Homo sapiens* alpha-tubulin isoform 1 mRNA |
| 640 | 57099 | *Homo sapiens* uncharacterized hypothalamus protein HBEX2 mRNA |
| 642 | 57105 | *Homo sapiens* splicing factor, arginine/serine-rich 7 (35kD) (SFRS7) |
| 643 | 57111 | Human chromosome 14 DNA sequence |

TABLE 6-continued

| SEQ ID NO:. | CLONE ID# | Genbank Homologies |
|---|---|---|
| 644 | 57117 | Human DNA sequence from cosmid V857G56, between markers DXS366 and DXS87 on chromosome X contains ESTs |
| 645 | 57121 | Homo sapiens genomic DNA of 8p21.3-p22 anti-oncogene of hepatocellular colorectal and non-small cell lung cancer, segment 3/11 |
| 646 | 57124 | H. sapiens MLN50 mRNA |
| 647 | 57125 | Homo sapiens calreticulin (CALR), mRNA |

TABLE 7

| SEQ ID NO:. | CLONE ID# | Genbank Homologies |
|---|---|---|
| 588 | 54533 | Novel |
| 598 | 55098 | Novel |
| 603 | 55108 | Novel |
| 611 | 55087 | Novel (partial overlap of Unknown: Homo sapiens partial mRNA, clone c1-10e16) |
| 616 | 56930 | Novel |
| 618 | 56945 | Novel |
| 622 | 55506 | Novel/(136bp: Mus musculus mRNA for Rab24 protein) |
| 623 | 56480 | Novel |
| 625 | 56484 | Novel |
| 629 | 56493 | Novel |
| 636 | 56959 | Novel |
| 639 | 57092 | Novel |
| 641 | 57100 | Novel (last 120 bp: Unknown: Canine 21 kDa Signal peptase subunit mRNA) |

In further studies, the expression levels of certain of these disclosed isolated antigens were compared to the expression levels in 36 normal tissues using microarray technology and computer analysis. These sequences were arrayed on Chip #7. The results of these studies are shown below in Table 8.

TABLE 8

| Clone Name | Clone ID # | SEQ ID NO: | Squa/N | Aden/N | SC/N |
|---|---|---|---|---|---|
| LSCC2-1 | 54533 | 588 | 3 | 2 | 1 |
| LSCC2-2 | 54534 | 589 | 5 | 3 | 5 |
| LSCC2-4 | 54536 | 590 | 3 | 2 | 2 |
| LSCC2-8 | 54540 | 592 | 0 | 3 | 2 |
| LSCC2-18 | 55084 | 593 | 2 | 2 | 1 |
| LSCC2-23 | 54555 | 595 | 2 | 3 | 3 |
| LSCC2-25 | 54557 | 596 | 2 | 1 | 1 |
| LSCC2-32 | 54564 | 597 | 2 | 3 | 2 |
| LSCC2-48 | 55473 | 599 | 4 | 2 | 1 |
| LSCC2-58 | 55104 | 600 | 3 | 5 | 2 |
| LSCC2-61 | 55107 | 602 | 2 | 5 | 3 |
| LSCC2-75 | 55483 | 607 | 2 | 4 | 2 |
| LSCC2-79 | 55487 | 609 | 3 | 2 | 2 |
| LSCC2-93 | 55089 | 612 | 5 | 4 | 4 |
| LSCC2-121 | 55490 | 619 | 4 | 2 | 2 |
| LSCC2-127 | 55495 | 620 | 2 | 4 | 1 |
| LSCC2-137 | 55504 | 621 | 0 | 3 | 8 |
| LSCC2-139 | 55506 | 622 | 3 | 4 | 1 |
| LSCC2-161 | 56480 | 623 | 3 | 2 | 1 |
| LSCC2-164 | 56482 | 624 | 2 | 4 | 2 |
| LSCC2-171 | 56488 | 627 | 6 | 4 | 5 |

TABLE 8-continued

| Clone Name | Clone ID # | SEQ ID NO: | Squa/N | Aden/N | SC/N |
|---|---|---|---|---|---|
| LSCC2-178 | 56494 | 670 | 3 | 5 | 3 |
| LSCC2-191 | 56517 | 673 | 5 | 2 | 2 |

Squa/N = fold overexpression in squamous lung tumor versus normal tissues
Aden/N = fold overexpression in adenocarcinoma versus normal tissues
SC/N = fold overexpression in lung small cell carcinoma versus normal tissues

EXAMPLE 12

Use of Mouse Antisera to Identify cDNA Sequences Encoding Lung Small Cell Carcinoma Antigens This example illustrates the isolation of cDNA sequences encoding lung small cell carcinoma antigens by screening a small cell carcinoma cell line cDNA library with mouse anti-SCID mouse sera.

A directional cDNA expression library was constructed with mRNA from small cell carcinoma cell line NCIH128 employing the Lambda ZAP Express expression system (Stratagene, La Jolla, Calif.). Sera was obtained from SCID mice containing human small cell carcinoma cell lines NCIH69 and NCIH128. The sera contains shed and secreted tumor antigens. These sera were pooled and injected into normal mice to produce anti-SCID mouse sera. The antiserum was absorbed with E. coli lysate, human GADPH protein and Ku autoantigens, and human PBMC lysate was added to the serum to block antibodies to proteins found in normal tissue.

Thirty-nine clones were isolated and the inserts of these clones were sequenced. The isolated clones and their respective sequence and clone identifier are presented in Table 9. The clone sequences were compared to sequences in publicly available databases (Geneseq, GenBank and huESTdb). A summary of these comparisons are found in Tables 10 and 11. Those showing some degree of homology with known sequences are described in Table 10, while those showing little or no similarity to known sequences are described in Table 11.

TABLE 9

| CLONE NAME | SEQ. ID. NO: | CLONE ID # |
|---|---|---|
| LSCC-8 | 648 | 50664 |
| LSCC-13 | 649 | 50669 |
| LSCC-18 | 650 | 50673 |
| LSCC-25 | 651 | 50680 |
| LSCC-33 | 652 | 50685 |
| LSCC-47 | 653 | 50699 |
| LSCC-48 | 654 | 50700 |
| LSCC-50 | 655 | 50702 |
| LSCC-52 | 656 | 50704 |
| LSCC-58 | 657 | 50710 |
| LSCC-59 | 658 | 50711 |
| LSCC-67 | 659 | 50719 |
| LSCC-68 | 660 | 50720 |
| LSCC-73 | 661 | 50725 |
| LSCC-75 | 662 | 50727 |
| LSCC-77 | 663 | 50729 |
| LSCC-84 | 664 | 50736 |
| LSCC-86 | 665 | 50738 |
| LSCC-88 | 666 | 50740 |
| LSCC-89 | 667 | 50741 |
| LSCC-92 | 668 | 50744 |
| LSCC-93 | 669 | 50745 |

TABLE 9-continued

| CLONE NAME | SEQ. ID. NO: | CLONE ID # |
|---|---|---|
| LSCC-103 | 670 | 50754 |
| LSCC-105 | 671 | 50756 |
| LSCC-106 | 672 | 50757 |
| LSCC-110 | 673 | 50761 |
| LSCC-112 | 674 | 50763 |
| LSCC-116 | 675 | 50767 |
| LSCC-145 | 676 | 50775 |
| LSCC-146 | 677 | 50776 |
| LSCC-147 | 678 | 50777 |
| LSCC-156 | 679 | 50786 |

TABLE 9-continued

| CLONE NAME | SEQ. ID. NO: | CLONE ID # |
|---|---|---|
| LSCC-157 | 680 | 50787 |
| LSCC-159 | 681 | 50789 |
| LSCC-167 | 682 | 51003 |
| LSCC-171 | 683 | 51007 |
| LSCC-178 | 684 | 51014 |
| LSCC-207 | 685 | 51304 |
| LSCC-239 | 686 | 51568 |

TABLE 10

| Seq. ID. No. | GenBank (ACCESS.#) | Description |
|---|---|---|
| 648 | D21094 | Human mRNA for motor protein |
| 652 | NM_004487 | *Homo sapiens* golgi autoantigen, golgin subfamily b, macrogolgin w/transmembrane signal |
| 653 | J04031 | Human methylenetetrahydrofolate dehydrogenase-methenyltetrahydrofolate cyclohydrolase-formyltetrahydrofolate synthetase mRNA |
| 654 | MN_007086 | *Homo sapiens* AND-1 protein (AND-1), mRNA |
| 657 | J03483 | Human chromogranin A mRNA |
| 658 | AF191340 | *Homo sapiens* anaphase-promoting complex subunit 7 (APC7) |
| 661 | AC020663 | *Homo sapiens* chromosome 16 clone RPC1-11 127120 |
| 662 | D13388 | Human mRNA for DnaJ protein homolog |
| 663 | AB014540 | *Homo sapiens* mRNA for KIAA0640 protein, partial cds |
| 666 | NM_005898 | *Homo sapiens* membrane component, chromosome 11, surface marker 1 (M11S1) |
| 667 | X75304 | *H. sapiens* giantin mRNA |
| 668 | Z29067 | *H. sapiens* AF-1p mRNA |
| 669 | AJ133129 | *H. sapiens* mRNA for small glutamine-rich tetratricopeptide repeat containing protein |
| 670 | AF058918 | *Homo sapiens* unknown mRNA |
| 671 | D89976 | *H. sapiens* mRNA for 5-aminoimidazole-4-carboxamide ribonucleotide transformylase |
| 672 | NM_001539 | *Homo sapiens* heat shock protein, DNAJ-like 2 (HSJ2) mRNA |
| 673 | AC020663 | *Homo sapiens* chromosome 16 clone RPCI-11-127I20 |
| 674 | D21235 | Human mRNA for HHR23A protein |
| 676 | MN_003804 | *Homo sapiens* receptor (TNFRSF)-interacting serine-threonine kinase 1 (RIPK1) |
| 677 | X76180 | *H. sapiens* mRNA for lung amiloride sensitive Na+ channel Protein |
| 678 | AB018330 | *Homo sapiens* mRNA for KIAA0787 protein, partial cds |
|  | U87803 | Human putative ca2+/calmodulin-dependent protein kinase gene, 3' flanking region |
| 679 | L31610 | *Homo sapiens* (clone cori-1c15) S29 ribosomal protein mRNA |
| 680 | Z83840 | Human DNA sequence from clone CTA-216E10 on chromosome 22 contains the NHP2L1 gene for non-histone chromosome protein 2 |
| 682 | D14696 | Human mRNA for KIAA0108 gene |
| 683 | Z47087 | *H. sapiens* mRNA for RNA polymerase II elongation factor-like protein |
| 684 | Z83840 | Human DNA sequence from clone CTA-216E10 on chromosome 22 contains the NHP2L1 gene |
| 685 | U01923 | Human BTK region clone ftp-3 mRNA |

TABLE 11

| Seq. ID. No. | GenBank (ACCESS.#) | Description |
|---|---|---|
| 649 |  | Novel |
| 650 | AC005023 | Unknown: *Homo sapiens* BAC clone GS1-42113 from Xq25-g26 |
| 651 |  | Novel |
| 655 | AC007199 | Unknown: *Homo sapiens* chromosome 5 BAC clone 111n13 |
| 656 | AC005988 | Unknown: *Homo sapiens* chromosome 17, clone hRPK.299_G_24 |
| 659 | AK001695 | Unknown: *Homo sapiens* cDNA FLJ10833 fis, clone NT2RP4001206, moderately similar to *Drosophila melanogaster* strawbeny notch mRNA |

TABLE 11-continued

| Seq. ID. No. | GenBank (ACCESS.#) | Description |
|---|---|---|
| 660 | AK001722 | Unknown: *Homo sapiens* cDNA FLJ10860 fis, clone NT2RP4001568, weakly similar to ZINC FINGER PROTEIN GCS1 |
| 664 | AK001925 | Unknown: *Homo sapiens* cDNA FLJ11063 fis, clone PLACE1004814, weakly similar to SPLICING FACTOR, ARGININE/SERINE-RICH 4 |
| 665 | | Novel |
| 675 | (AJ131096) | Novel (1 to 103 bp is Picea abies microsatellite RNA), clone PAAG2 |
| 681 | AP001065 | Unknown: *Homo sapiens* genomic DNA, chromosome 21, clone:KB68A7, MX-D21S171 region |
| 686 | | Novel |

In further studies, the expression levels of certain of these disclosed isolated antigens were compared to the expression levels in 36 normal tissues using microarray technology and computer analysis. These sequences were arrayed on Chip #7. The results of these studies are shown below in Table 12.

TABLE 12

| Clone Name | Clone ID # | SEQ ID NO: | Squa/N | Aden/N | SC/N |
|---|---|---|---|---|---|
| LSCC-8 | 50664 | 648 | 4 | 3 | 2 |
| LSCC-13 | 50669 | 649 | 2 | 4 | 0 |
| LSCC-59 | 50711 | 658 | 4 | 2 | 3 |
| LSCC-84 | 50736 | 664 | 6 | 3 | 4 |
| LSCC-86 | 50738 | 665 | 1 | 4 | 0 |
| LSCC-88 | 50740 | 666 | 2 | 3 | 4 |
| LSCC-92 | 50744 | 668 | 3 | 1 | 1 |
| LSCC-105 | 50756 | 671 | 4 | 3 | 2 |
| LSCC-106 | 50757 | 672 | 4 | 3 | 1 |
| LSCC-110 | 50761 | 673 | 8 | 3 | 4 |
| LSCC-146 | 50776 | 677 | 3 | 1 | 1 |
| LSCC-147 | 50777 | 678 | 5 | 2 | 3 |
| LSCC-156 | 50786 | 679 | 4 | 2 | 2 |
| LSCC-159 | 50789 | 681 | 2 | 2 | 1 |
| LSCC-171 | 51007 | 683 | 2 | 1 | 1 |
| LSCC-207 | 51304 | 685 | 3 | 4 | 3 |
| LSCC-239 | 51568 | 686 | 4 | 3 | 2 |

Squa/N = Squamous lung tumor versus Normal tissues
Aden/N = Adenocarcinoma over versus tissues
SC/N = Lung Small Cell carcinoma versus Normal tissues

EXAMPLE 13

Use of Mouse Antisera to Identify cDNA Sequences Encoding Lung Small Cell Carcinoma Antigens This example illustrates the isolation of cDNA sequences encoding lung small cell carcinoma antigens by screening a small cell carcinoma cell line cDNA library with mouse anti-SCID mouse sera.

A directional cDNA expression library was constructed with mRNA from a SCID-passaged human lung cancer tumor DMS79 employing the Lambda ZAP Express expression system (Stratagene, La Jolla, Calif.). Sera was obtained from SCID mice containing the human lung cancer tumors DMS79 and NCIH688. The sera contains shed and secreted tumor antigens. These sera were pooled and injected into normal mice to produce anti-SCID mouse sera. The antiserum was absorbed with *E. coli* lysate, human GADPH protein and Ku autoantigens, and human PBMC lysate was added to the serum to block antibodies to proteins found in normal tissue.

Forty-one clones were isolated and the inserts of these clones were sequenced. The isolated clones and their respective sequence identifiers are presented in Table 13. The clone sequences were compared to sequences in publicly available databases. A summary of these comparisons are found in Tables 14 and 15. Those showing some degree of similarity with known sequences are described in Table 14, while those showing little or no similarity to known sequences are found in Table 15.

TABLE 13

| CLONE NAME | SEQ. ID. NO:. | CLONE ID # |
|---|---|---|
| DMS-3 | 687 | 48564 |
| DMS-8 | 688 | 48567 |
| DMS-9 | 689 | 48568 |
| DMS-12 | 690 | 48571 |
| DMS-14 | 691 | 45572 |
| DMS-25 | 692 | 48578 |
| DMS-35 | 693 | 48583 |
| DMS-38 | 694 | 48584 |
| DMS-39 | 695 | 48585 |
| DMS-47 | 696 | 49059 |
| DMS-50 | 697 | 49061 |
| DMS-53 | 698 | 49065 |
| DMS-61 | 699 | 49070 |
| DMS-63 | 700 | 49072 |
| DMS-64 | 701 | 49073 |
| DMS-67 | 702 | 49076 |
| DMS-75 | 703 | 50793 |
| DMS-76 | 704 | 50794 |
| DMS-79 | 705 | 50797 |
| DMS-84 | 706 | 50800 |
| DMS-93 | 707 | 50805 |
| DMS-126 | 708 | 50984 |
| DMS-129 | 709 | 50986 |
| DMS-139 | 710 | 51065 |
| DMS-151 | 711 | 51070 |
| DMS-164 | 712 | 51078 |
| DMS-168 | 713 | 51080 |
| DMS-175 | 714 | 51084 |
| DMS-193 | 715 | 51095 |
| DMS-199 | 716 | 51099 |
| DMS-200 | 717 | 51100 |
| DMS-204 | 718 | 51103 |
| DMS-214 | 719 | 51112 |
| DMS-218 | 720 | 51113 |
| DMS-221 | 721 | 51116 |
| DMS-232 | 722 | 51123 |
| DMS-253 | 723 | 51212 |
| DMS-270 | 724 | 51220 |
| DMS-275 | 725 | 51224 |
| DMS-289 | 726 | 51234 |
| DMS-296 | 727 | 51239 |

TABLE 14

| SEQ ID NO: | GenBank |
|---|---|
| 687 | KIAA0013:cDNA from Ru. BM myeloblast line |
| 688 | Hu. Flomolo Mu. LLRep3, sim. To ribosomal S2 |
| 689 | KIAA0769, Ru. brain protein |
| 690 | Hu. Thymidylate kinase (CDC9), regul'n |
| 691 | Hu. Ku autoimmune Ag; Nuc. Fctr. IV |
| 692 | Hu. Polyubiquitin UbC |
| 693 | Hu. FLJ20423 fis (signet-ring cell carc. Celline) |
| 694 | KIAA0640, SWAP-70 (Hu, brain protein) |
| 695 | Human radixin (cytosleletal) |
| 696 | Hu. Ribosomal protein L13a |
| 697 | Hu. trk oncogene, cytoskltl. Tropomyosin |
| 698 | DKFZp586K2120 (uterus) KIAA0784 brain |
| 699 | Hu. Chromogranin A (parathyr. Secrtry. Pro. 1) |
| 700 | Hu. Glutathione-S-transferase homolog |
| 701 | Hu. lactate dehydrogenase-A |
| 702 | Hu. GPI-anchored membr. Pro. p137 |
| 704 | Hu. HMG-17 |
| 705 | Hu. Ubiguitin C-terminal hydrolase (UHX1) |
| 706 | Hu. Cosmid 25, PAC clone RP5-901A4 |
| 707 | Hu. lactate dehydrogenase B |
| 708 | Hu. NuMA gene |
| 709 | Hu. KIAA0008 gene |
| 710 | Hu. BCL2/adenovirus E1B pro.2 (BNIP2) |
| 711 | Hu. Unactive progesterone receptor P23 |
| 712 | Hu. alpha II spectrin |
| 713 | Hu. Transcriptional coactivator ALY |
| 714 | Hu. DnaJ Heat Shock homolog |
| 715 | Hu. mitoch. Or Replication |
| 716 | Hu. Ornithine decarboxylase antizyme (brain |
| 717 | Hu. Deoxycytidine kinase |
| 718 | Hu. Fumarase |
| 719 | Hu. 80K-H protein (kinase C substrate) |
| 721 | Hu. Neuro-d4 (rat) homolog |
| 722 | Hu. Sodium/glucose cotransporter, repeat |
| 724 | Hu. Zinc finger protein ZNF226 |
| 725 | Hu. Jumping transloc'n brkpt. Gene |
| 726 | Hu. M-phase phosphoprotein |
| 727 | Hu. Peroxisomal signal receptor 1 |

TABLE 15

| SEQ ID NO: | GenBank |
|---|---|
| 703 | Novel |
| 720 | Novel (ALU?) |
| 723 | Novel |

EXAMPLE 14

Analysis of cDNA Expression Using Microarray Technology

In additional studies, four clones obtained in Example 13 were found to be overexpressed in specific tumor tissues as determined by microarray analysis. Using this approach, cDNA sequences are PCR amplified and their mRNA expression profiles in tumor and normal tissues were examined using cDNA microarray technology essentially as described (Shena et al., 1995). In brief, the clones are arrayed onto glass slides as multiple replicas, with each location corresponding to a unique cDNA clone (as many as 5500 clones can be arrayed on a single slide, or chip). Each chip is hybridized with a pair of cDNA probes that are fluorescence-labeled with Cy3 and Cy5, respectively. Typically, 1 µg of polyA$^+$ RNA is used to generate each cDNA probe. After hybridization, the chips are scanned and the fluorescence intensity recorded for both Cy3 and Cy5 channels. There are multiple built-in quality control steps. First, the probe quality is generally monitored using a panel of ubiquitously expressed genes. Secondly, the control plate also can include yeast DNA fragments of which complementary RNA may be spiked into the probe synthesis for measuring the quality of the probe and the sensitivity of the analysis. Currently, the technology offers a sensitivity of about 1 in 100,000 copies of mRNA. Finally, the reproducibility of this technology can be ensured by including duplicated control cDNA elements at different locations.

The extended predicted full length sequences for partial sequences of clones, DMS39, DMS126, DMS218 and DMS253 (previously isolated in Example 13) were obtained from the GenBank databases after database searches using the original partial cDNA sequences as the query. The predicted full length sequences for the cloned cDNA sequence for clones DMS39, DMS126, DMS218 and DMS253 are provided in SEQ ID NO: 728–731, respectively. SEQ ID NO: 728–731 were analyzed by comparison to sequences in the publicly available databases. A summary of these comparisons is presented in Table 16.

TABLE 16

| SEQ ID NO: | Clone Name | Blastn |
|---|---|---|
| 728 | DMS-39 | Human radixin |
| 729 | DMS-126 | Human nuclear mitotic apparatus protein |
| 730 | DMS-218 | Hu. cDNA: FLJ21840 fis; XPMC2 |
| 731 | DMS-253 | Hu. mRNA for KIAA1582 protein |

EXAMPLE 15

Analysis of cDNA Expression Using Microarray Technology

In an additional study, a clone obtained in Example 12 was found to be overexpressed in specific tumor tissues as determined by microarray analysis. Using this approach, the cDNA sequence is PCR amplified and its mRNA expression profiles in tumor and normal tissues was examined using cDNA microarray technology as described in Example 13. Microarray analysis showed the cDNA for LSCC-86 is strongly overexpressed in small cell carcinoma cell line HTB 173; moderately overexpressed in atypical carcinoid METs, adenocarcinoma lung tumors and squamous lung tumors; and slightly overexpressed in primary small cell. This cDNA is also strongly overexpressed in pituitary gland; moderately overexpressed in brain and adrenal gland; and slightly overexpressed in skeletal muscle.

Clone LSCC-86 was originally isolated in Example 12 and a partial sequence of this insert is provided in SEQ ID NO: 665. An extended sequence was obtained by PCR sequencing using internal primer sequences designed from the partial cDNA sequence of clone LSCC-86. This extended sequence represents the full-length sequence for the cloned cDNA sequence of clone LSCC-86. The determined full length sequence for LSCC-86 is provided in SEQ ID NO: 732. SEQ ID NO: 732 was analyzed by comparison to sequences in the publicly available databases. Database searches showed no homology in GenBank, seven ESTs (3 lung tumor and 4 uncatagorized hits) in the human EST database, and no homology in Blastx. Three open reading frames (ORFs) were identified. A first that encodes a protein with a sequence of 50 amino acid residues (SEQ ID NO: 733) which is fused to LacZ. A second that encodes a protein with a sequence of 76 amino acids residues (SEQ ID NO: 734) which shows no homology in the databases. A third that encodes a protein with a sequence of 74 amino acid residues (SEQ ID NO: 735) which also shows no homology in the databases. However, a motif search of SEQ ID NO: 735 shows a possible small cytokine signature.

From the foregoing it will be appreciated that, although specific cembodiments of the invention have been described herein for purposes of illustration, various modifications may be made without deviating from the spirit and scope of the invention. Accordingly, the invention is not limited except as by the appended claims.

SEQUENCE LISTING (735 sequences)

SEQ ID NO: 1 - DNA, 339 bp, Homo sapien
gtactcagacaggatagtcatcatgtagcacaaagcamatcctgtttctatacttgtagtttgctctcactcagtggcatratcattactatacagtgtagaatgttrttatgtagcatagatgtggggtctctagcccacagctctstacctttgtctagcactcctgtcctcatacctragtggcctgtccatcagcatgtttctcatctactttgcttgtccagtccactgtggtcctcccttgccctctcccttatgtggcagagtggaaccagctgtcctgagacttgagttcaacatctggttcgcccatytgcatgtttgtggtctgagtac

SEQ ID NO: 2 - DNA, 698 bp, Homo sapien
  misc_feature (1)...(698): n = A,T,C or G
gtactcagaccacgactgcattttctccactgctgacgggtctaataccagctgcttccctttcttggaggcagagctngtgaccttgagaaagtgacctgtgaccatcatgtgggtagtgagctgctgcaaggtgtcatgggagctcccacactccatgcactttwagatctgggacttgcaggcctcaractgccaggtgtagctcgctccattttggtagccatagcgsttgttggaggacaactgcaagttggcgttcttctgagaagaaaaagaatctgcaaaagatcctgtggttgaatcgggggaacacggccgattgacatcaaaaacgcgtttcttagcccgggtgaccattttcgaggaaatggttggggactggctccttcaaaggcactttttggttatgttttgtttyaatcatgtkgacgctccaatcttggragggaatcgaangrantcnccnccaaaacatrcstttcagraaccttttgarcatcctcttttttccgtrtcccggmaargcccytttccckgggctttgaaawyagcctsgttgggttcttaaattaccartccacnwgttggaattccccgggccccctgcccggktccaaccaattttgggraaaacccccncansccgttkggantgcnacaacntggnntttttcntttcgtgntcccctngaacc

SEQ ID NO: 3 - DNA, 697 bp, Homo sapien
  misc_feature (1)...(697): n = A,T,C or G
gtactcagacccccaacctcgaacagccagaagacaggttgtctcctgggccttggacacagccngccaggccattgaagganaagcaaagacgaagcgaaccatctctctccattgtgggggccaagtagctgcantanccttcagtcccagttgcattgggttaaagagctcatacatactatgtgtnaggggtacagaagcttttcctcatagggcatgagctctccnagagttgaccttttgcctnaacttggggtttctgtggttcataaagttnggatatgtattttttttcaaatggaanaaaatccgtatttggcaaaaagactccagggggatgatactgtccttgccacttacagtccaaangatnttccccaaagaatagacattttttcctctcatcacttctggatgcaaaatcttttatttttttcctttctcgcaccnccccagaccccttnnaggttnaaccgcttcccatctcccccattccacacgatnttgaattngcannncgttgntggtcgggtcccnnccgaaagggtntttttattcggggtnctganttnnnaaccnctnagttgaatccgcggggcggccnngngggttnnaccatgntgggganaactncccnccgcgnttggaatgccanagccttgaaanttttcttttggtcgccccccngagattc

SEQ ID NO: 4 - DNA, 712 bp, Homo sapien
  misc_feature (1)...(712): n = A,T,C or G
gtactcagacaaccaataggtgtgttyctcanatctgaaacacaaaaagattctagctnataatgttsaatggttgagggtttaagtgatcttggtatgttngatttagcagcgatnggccgggtgcggtggctcacgcatgtatcccagcactttgggaggccgaggcaggaggatcacctgaggtcaggagtttgagaccagcctggccgacatggtnaaaccccgtctctactangaatacanaaattagcccgggcatagtggcgcgtgcctrtgacctcsgctactttggggattctcctgaggaagaattgcttgaactcagggaagtggargtttgcagtgagcttaaatcaagccactggcactcccagcctgggktaacagagccamgactctkgccgaaaaaaaaraamacgacggagaanmagntctgttattccatgggaaattkgaatttccttcyttkaaatatcttaaaatnggtcctcctwaaaaaagttcggctggggcccgktggctcacattttkttaycccycccccttttggggarggccaarggccggkttgawtnncccttgaggggccanaactccagnaaccrgncccgggccarsmgwkgkstrarmccctttccyyccmaraaaawwcsmaaawwttycccsccygsykggctggkasckgttmyyyyygmtmcsyagcttgctt

SEQ ID NO: 5 - DNA, 679 bp, Homo sapien
  misc_feature (1)...(679): n = A,T,C or G
gtactcagaccacctcacatgcagggtnagaaacatggagtgtgcggcagcatcctcctcacatccctttgtgagcacggctgctccggaatactgaccatctgggctagcacgacctaacagagggttctgcaggatgtgctattttaaagcagctgggtgcaacttgtgaaaacgggaatctngaagcagaacatgtnatcagcgatggctgggattggtggacaggattgacaggagtatttgaggctctaccaggcctgtctacaggacagcttcatcgaagggacattttttaacctgttattttanatnccacatatnttttttaatgctnaagcatacaggttgaatttctggatcgtaactactagtgacttctgaggtttacagttngaatatgttctcnnaggtttatcaagttntgttattgatgatnggtaatctacacctctggaagctgtngaatgtgaaaaagatncntncanctgaccagtttgnagggcactctcttctggnaagnaatccgnccaaaaaaattgtttcnagggggcntggggggtttaaaaaaatgtttctnttnccntaaaaatgtttacccnnctattgaaaaaatgggggtcgnggggggcttnaaatccccnanttntgaatnttntatccggaancttggtttccc

SEQ ID NO: 6 - DNA, 369 bp, Homo sapien
  misc_feature (1)...(369): n = A,T,C or G
tcagtccagtcatgggtcctataagagaagtcactctgtgagtttccatggaggaagaaaaagcttcatttctttaccctgcagcaacagcggagggagggagagcctatcttctttgcaaattcattaactttgtggttgaagggagcagcgtcngaaactgctttagcacagtgggaggaaaacaaacagattcatctccggaaaccaaaggaaagggtragtgggtttttattagccagctgtatcctagatggtcaatttccagtggatgaatacaccttacgtacgtttctcttgcttcctacctnggcctgatcagctnggcacttraatcattccgtnggggtwgctgtnacactggactga

SEQ ID NO: 7 - DNA, 264 bp, Homo sapien
  misc_feature (1)...(264): n = A,T,C or G
tgctggatragggatggggcacgggagcacagatmgactttaactgcccccacgttntcmaggaaaggattacaggcgtgagccactgcgcccggcctcttctccactttcataggttccagtctctggttcttctttctcagtttgttgtttttgcttcttaaatmatggagatnagaatgaacactacactcggaatcaggaagccctgcctggcgcctctgtcacctgtctaggggcttcttctcactgagtcatccagca

SEQ ID NO: 8 - DNA, 280 bp, Homo sapien
  misc_feature (1)...(280): n = A,T,C or G
acctcaactgcccanaacanaactgttgtacaagatttgaggatttaacaatatttcacatgaaatatttcagacctacgngagggcttaaagacnaattaaatgagcaccngtgtgcccaccgccccnattaagaattagagcaagcagtgaggtgaagccttgtccttgcttttaacatagaaagtgatccaaattcaccaaacttgacttnnggttttgcagtgtggcctcctgattctagacnctggcgaaacatttgatgggcaaaaaaaaaaaa

SEQ ID NO: 9 - DNA, 449 bp, Homo sapien
  misc_feature (1)...(449): n = A,T,C or G
tcgtcaactccaggatggctttgaaaatnaatggacacagatctctcctgttttgatratntgcagtgctnatgactggctttgcagttnattttgattcaggcaacagatgttccttttggttccctgtctcccatgggcgtcatttcatgttgtcctctgccttcccccagatattctaagttcaggacacaagcttctggcccatgcagagcagaggccatgaggggtcacagcatgggtacgggaggaaacactgggctnacccagatnctggacttgagtcttgcctctgctgcttgctgcacagcttctgtcatggtgctaaacctgtgacctgcctcacaggcttagagcatgcccgtagaagtactctnaactaaratgctttccacaaatgagatggtttcatgaaaacttcaaatagagggcctgggcaaaaaaaaaaa

SEQ ID NO: 10 - DNA, 538 bp, Homo sapien
  misc_feature (1)...(538): n = A,T,C or G
ttttttttttttcccaaaggcctcaraacactagtcttctaattccaagcagaaagttacatccgccgggatacatgccacttggtttgataaatcaaaatacagcatccttcagatccctttgctgagcaatacaattatttgtatatgttacttttttttctgtttggctnaaagatttgatatgagctgaggaaaatgaagccnttactgctatnagatctnatccctttccaccacctttcagggatnttggcactgcayatattcagaattccccnnagtcgctngtgataaaaatgtcttcagagatggcagaatatgtttcctttggtacatgttcattaaaaatatacacgtgctcactactgtggatatgtatgtnttgaccgatnacacaggctgatttagggaagagataaaagcacacttngaatttattagcctttcaccnagactaanattctgaaattaagaatgtattccttggtcaacaattttcctcttctcttagccctcttacattgtantggactga

SEQ ID NO: 11 - DNA, 543 bp, Homo sapien
  misc_feature (1)...(543): n = A,T,C or G
ttttttttttttgcccacagctgccatctttgtgtgataaggccaaccttctatgggaatcaaccctcgccatcccagcaaatcccctctctcccttctcatgggagtgccttgtattcatcaggcatctgggacttgatgtgggtntgggatttgaaatcagagcacctnggtctctstcaccattctntcacttattagctctnaccttgggtnaatacctgccttagtgtcntaggtacaatatgaatattgtctatttctcagggattgcaatgacnagtnnatnagtgcatgagagggtaaaaccacagggtactccgctcctccnaagaatggagaattttttctagaagcccanatntgcttggaaggttggccaccnagagccnnaatcttcttttatttnccactgaangcctaagaggnaattctgaactcatccccnnatgacctctcccgaatmagaatatctctggcacttaccatattttcttgccctcttccacttacnaaactcctttattccttaacnggacgaaa

SEQ ID NO: 12 - DNA, 329 bp, Homo sapien
cgatgacttgggcagtgagtgggcctcctgccaggtggcagggcacagcttagaccaaacccttggcctcccccctctgcagstacctctgaccaagaaggaaactagcaagcctatgctggcaagaccataggtggggtgctgggaatcctcggggccggctggcacccactcctggtgctcaagggagagacccacttgttcagatgcatrggcctcaggcggttcaaggcrgtcttagagccacagagtcaaataaaaatcaattttgagagaccacagcacctgctgctttgatcgtgatgttcaaggcaagttgcaagtcatcg

SEQ ID NO: 13 - DNA, 314 bp, Homo sapien
  misc_feature (1)...(314): n = A,T,C or G
cgatgacttgcacccgggagctgtgacagtggcctggaagcagatggcagccccgtcaaggcgggagtggagaccaccaaaccctccaaacagagcaacaactagtacgcggccagcagctacctgagcctgacgcccgagcagtggaagtcccacagaagctacagctgccaggtcacgcatgaagggagcaccgtggagaagacagtggcccctacagaatgttcataggttcccnactctnaccccacccacgggagcctgganctgcangatcccgggggaagggtctctctccccatcccaagtcatcg

SEQ ID NO: 14 - DNA, 691 bp, Homo sapien
  misc_feature (1)...(691): n = A,T,C or G
cgattacttgcacaatgcanattagaacccaaatgaagggtacaacccagatcttctggcttccagttcagtgctgctgggtttttcttactaaaccaaaacaatkaagagcatagaagggaagagaagaataaagtctattttggtctttggtagcchgggtaangagaatgctstcactctacnagaaaacccnaagtgaacccggctaatcaggaccgtgcttgggaagggagcaggggcattacctttcaacaccagaggttctttgccttctctctgcagggactcgargactatgtgaagtggctgggarggcatcactcggcttggttcattggtrttctcatcataaactatnatttctttggaaaaagatcctcttgaaagartccttgccttccctacaggaaatcaagtctaggacagtgatcttgcccctgcttgcastctccgccggctgatcttatcsgscccagttkatgtgsamcgctccttggatrtkactcttgttttwctccvaggaaggggcytgcmagtccnwtnaatgamssgggcccttaactccggscrggtnamyncttgsctscrattttgggtycytcttcytttgsccmggttcktcnaaaccacttngttraattccccggsccgcctkgcnggtycaaccwttttgggaamamcycccccc

SEQ ID NO: 15 - DNA, 355 bp, Homo sapien
  misc_feature (1)...(355): n = A,T,C or G
acctgaactgtgtgttgaagagtgatgtcctgctgcctggagctcaagtcactactgatgaccgtgcctatgtccgacagctagttncctccatggatgtgactgagaccaatgtcttcttcyaccctcggctcttacctttgacnaagtctcccgttgagagtactaccgaaccaccagcagttcgagcctctnaagagcgtctaagcgatggggatatatatttactggagaatgggctcaacctcttcctctgggtgggagcaagcgtccagcagggtgttgtccagagccttttcagcgtctcctccttcagtcagatcaccagtggtntgagtgttctgccagttcaggt

SEQ ID NO: 16 - DNA, 522 bp, Homo sapien
  misc_feature (1)...(522): n = A,T,C or G
tcagtccagtgaggtggaagacttcgaggctcgtgggagccgcttctccaagtctgctgatgagagacagcgcatgctggtgcagcgtanggacgaactcctccagcaagctcgcagacgtttcttgaacaaaagttctgaagatgatgcggcctcagagagcttcctcccctcggaaggtgcgtcctctgaccccgtgaccctncgtcgaangatgctggctgccgccgcggaacggangcttcagaagcagcagacctcctngcgctcccttgccttcctcagctgcctcctgcgccctgtgcccggctgactggaggaggcctgtccaattctgcccgccccatggaaaagcgggcttgactgcattgccgctgtatnaaagcatgtggtcttacagtgttnggacngctnatnaatttnatcctnctntgtaatacttcctatgtgacatttctcttccccttggaaacactgcanattttaactgtgagtttgatctcttctngtgttactggactg

SEQ ID NO: 17 - DNA, 317 bp, Homo sapien
gtgtcgcgaattcgcggtggtgctaagaaaaggaagaagaagtcttacaccactcccaagaaggataagcaccagagaaagaaggttcagccggccgtcctgaaatattataaggtggatgagaatggcaaaattagttgccttcgtcgagagtgcccctctgatgaatgtggtgctggggtgtttatggcaagtcactttgacagacattattgtggcaaatgttgtctgacccactgtttcaactaaccagaagacaagtaactgtatgagttaattaaagacatgaactaaaaaaaaaaaaaaaaaaactcgag

SEQ ID NO: 18 - DNA, 392 bp, Homo sapien
tggagatttctaatgaggtgaggaagttccgtacattgacagaattgatcctcgatgctcaggaacatgttaaaaatccttacaaaggcaaaaaactcaagaaacacccagacttccccaagaagcccctgaccccttatttccgcttcttcatggagaagcgggccaagtatgcgaaactccaccctcagatgagcaacctggacctgaccaagattctgtccaagaaatacaaggagcttccggagaagaagaagatgaaatatgttccggacttccagagaagagaaacaggagttcgagcgaaacctggcccgattcagggaggatcacccccaccttatccagaatgccaagaatcggacatcccagagaagccccaagaccccccg

SEQ ID NO: 19 - DNA, 2624 bp, Homo sapien
gaaacagtgagaaggagattcctgtgctcaatgagctgccagtccccatggtggcccgctacattcgcataaaccctcagtcctggtttgataacgggagcatctgcatgaggatggagatcttgggctgcccactgccggatcctaataactattatcaccgacgtaatgagatgaccaccacggatgacctggattttaagcaccacaactattaggaaatgcgccagttgatgaaggttgtcaatgaaatgtgccccaatattaccaggatttacaacattggcaaaagccaccagggcctgaaattgtatgcggtagagatctctgaccatcctggggaacatgaagttggtgagcccgagttccactacatcgcaggggcccacggcaatgaggttctgggacgagaactgctgctgctgctgctgcacttcctctgccaggaatactcggcgcagaacgcacgcatcgtccgcttggtggaggagactcgaatccacattctaccctccctcaatcctgatggctatgagaaggcctatgaaggaggttccgagttgggaggctggtccctgggacgttggacccatgatggcatcgatatcaacaacaactttccggatttaaactcgctgctctgggaggcagaggaccagcagaatgccccaaggaaggtccccaaccactacattgccatccctgagtggtttctgtctgagaatgccacagtggccacagagaccagagccgtcatcgcctggatggagaagatcccgtttgtgctgggaggcaacctacaggggggtgagctggtcgtggcatacccctatgacatggtgcggtccctgtggaagacccaggagcacaccccaacacctgatgatcatgtgttccgctggctggcgtattcctacgcctccactcaccgcctcatgacagatgccaggaggcgagtgtgccacacggaagattttcagaaggaggagggcaccgtcaatggggcttcctggcacacagtggctggaagtctaaacgatttcagctacctccatacaaactgctttgagctgtccatctacgtgggctgtgataaatacccacacgagagcgagctgccggaggaatgggagaataaccgggagtctctgattgtgttcatggagcaggttcatcgaggcatcaaaggcatagtgagagatttacaagggaaagggatttcaaatgctgtcatctctgtggaaggtgttaaccatgacatccggacagccagcgatggggattactggcgtctactgaaccctggcgaatatgtggtcacagccaaggcggaaggctttatcacttccaccaagaactgcatggttggctatgatatgggagctactcggtgtgacttcaccctcacaaagaccaacctggctaggataagagaaattatggagacatttgggaagcagcctgtcagcctaccctccaggcgcctgaagctgcggggacggaaaaggcggcagcgtgggtgaccctgtcggacacttgagacataccccagaccgtgcaaataaaaatccactccagtagtaactctgtagcaggctttccctgttgttttgactgtaattcaagagacactcaggagcatacctgcatggcttggctgaccccaaaggggagggctggtggctcagggtgttttgttttttgttttttgttttttcctttgttctcatttatccaaataccttgaacagagcagcagagaaaggccggtggcagtgagggaattaattcagtgagtcagtctgagattctaaaaagggtgcttgaccactggccaggaagggaaatcaggccttcccccatttgcgtgacattcaagcttcccagtgcatttgcaagtggcacagttgacattgcagcacccagggaatcctttgccccagatgttatcatttgagatgctcttatgcagcctaagaaaatccatcctctctggccccaggggacaagccaagctgctatgtacacactcggtgttctattgacaatagaggcatttattaccaagtgtgcatcgctgagtcctaaatcagctctgttcctttttccaacaaagcttgtcttcctaagagcagacagaagtggagagcacccaagaatgagtgctgggcagcagaccctgggggagggggcttgctatcccagaaagcccctaaaccctttgctgctccattagccctggggtgaggagagccagacatgttaggaggccagagcagtcagtcagggcatcttggaaaagaccttgaaggaagcaaaccctgggttccttttgctccagaatgtgagagctccaagttggccccaatcaggaggggagtaatgatgaacatacagacggccacatcttgccaatcaagcatcatctgatgaaaaagaaagcaatcttaggattacctgggacacgtcagtctgggagaggtggttgaatcattgtgtaagggaatagtgtatctaatctgtgttgatcctgctgccttgttgacctggagagaatgaaacaaacaaacacataaacaaataaagcaaatggtaagattaaaaaaaaaaaaaaaaaactcgag

SEQ ID NO: 20 - DNA, 488 bp, Homo sapien
ctttcaacccgcgctcgccggctccagccccgcgcgcccccaccccttgccctcccggcggctccgcagggtgaggtggctttgaccccgggttgcccggccagcacgaccgaggaggtggctggacagctggaggatgaacggagaagccgactgccccacagacctggaaatggccgcccccagaggccaagaccgttggtcccaggaagacatgctgactttgctggaatgcatgaagaacaaccttccatccaatgacagctcccagttcaaaaccacccaaacacacatggaccgggaaaaagttgcattgaaagacttttctggagacatgtgcaagctcaaatgggtcgagatctctaatgaggtgaggaagttccgtacattgacagaattgatcctcgatactcaggaacatgtttaaaatccttacaaaggcaaaaaatcaagaaacaccccgacttccccgagaaagcccctaaccc

SEQ ID NO: 21 - DNA, 391 bp, Homo sapien
atggaattgtggttttctctttgggatcaatggtctcagaaattccagagaagaaagctgtggcgattgctgatgctttgggcaaaatccctcagacagtcctgtggcggtacactggaacccgaccatcgaatcttgcgaacaacacgatacttgttcagtggctaccccaaaacgatctgcttggtcacccaatgacccgtgcctttatcacccatgctagttcccatggtgttaatgaaagcatatgcaatggcgttcccatggtgatgatacccttatttggtgatcagatggacaatgcaaagcgcagggagactaagggagctggagtgaccctgaatgttctggagatgacttctgaagatctagaagatgctctgaagagcag

SEQ ID NO: 22 - DNA, 1320 bp, Homo sapien
aatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgcttactgcagtgcatggtattcagtcagcttttgatgaagctatgtcatactgtcgatatcatccttccaaagggtattggtggcacttcaaagatcatgaagagcaagataaagtcagacctaaagccaaaaggaaagaagaaccaagctctatttttcagagacaacgtgtggatgctttacttttagacctcagacaaaaatttccacccaaatttgtgcagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggcgggcgcccatagtcccagctactcgggaggctgagacaggagacttgcttgaacccgggaggtggaggttgccctgagctgatcatcctgctgttgcactccagcttgggcgaaagagcgagactttgtctctataaagaaggaaagatattattcccatcatgatttcttgtgaatatttgtaatatgttttttgtaacctttcctttcccggacttgagcaacctacacactcacatgtttaatggtagatatgttttaaagcaagataaaggtattggttttaaaaaaaaaaaaaaaaaaaaaaaactcgag

SEQ ID NO: 23 - DNA, 633 bp, Homo sapien
ctaagggcagtgaaggtgaaaaccctctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccgacttcatcctgtgaagccaatgaatgccacggccaccaaggttgctaactgcagcttgggaactgccaccatcatcggtgagaacttgaacaatgaggtcatgatgaagaaatacagcccctcggaccctgcatttgcatatgcgcagctgacccacgatgagctgattcagctggtcctcaaacagaaggaaacgataagcaagaaggagttccaggtccgcgagctggaagactacattgacaacctgctcgtcagggtcatggaagaaacccccaatatcctccgcatcccgactcaggttggcaaaaaagcaggaaagatgtaaattagcagaaaaaaaactcgag

SEQ ID NO: 24 - DNA, 1328 bp, Homo sapien
gtaaacgctctcggaattatggcggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgcttactgcagtgcatggtattcagtcagcttttgatgaagctatgtcatactgtcgatatcatccttccaaagggtattggtggcacttcaaagatcatgaagagcaagataaagtcagacctaaagccaaaaggaaagaagaaccaagctctatttttcagagacaacgtgtggatgctttacttttagacctcagacaaaaaatttccacccaaatttgtgcagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttatttttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggcgggcgcccatagtcccagctactcgggaggctgagacaggagacttgcttgaacccgggaggtggaggttgccctgagctgattatcatgctgttgcactccagcttgggcgacagagcgagactttgtctcaaaaaagaagaaaagatattattcccatcatgatttcttgtgaatatttgtgatatgtcttctgtaacctttcctctcccggacttgagcaacctacacactcacatgtttactggtagatatgtttaaaagcaaaataaaggtatttgtataaaaaaaaaaaaaaaaaactcga

SEQ ID NO: 25 - DNA, 1758 bp, Homo sapien
gtttttttttttttttttttaaagagttgcaacaattcatctttatttcttattttcctctggagatgcagaatttggtatatttcaccccaagtatatttgggatagttggctcctcgctgggtcaggatggctgggtgccttctcccctggcatggttctcttctctgcagggcgaggggcagggagctagtaaaacctcgcaatgacagccgcaatggcagacccaatggagcccaggatgaacttggtcaatccggagagtccagttgctcccagtgactgcagagtagccacaaggctgcccgaggcaactccacccccattggcaatggccgccgcggacatcatcttggctgctatggaggacgaggcgattcccgccgcagtgaagcccatggcactgagtggcggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgcttactgcagtgcatggtattcagtcagcttttgatgaagctatgtcatactgtcgatatcatccttccaaagggtattggtggcacttcaaagatcatgaagagcaagataaagtcagacctaaagccaaaaggaaagaagaaccaagctctatttttcagagacaacgtgtggatgctttacttttagacctcagacaaaaatttccacccaaatttgtgcagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggcgggcgcccatagtcccagctactcgggaggctgagacaggagacttgcttgaacccgggaggtggaggttgccctgagctgattatcatgctgttgcactccagcttgggcgacagagcgagactttgtctcaaaaaagaagaaaagatattattcccatcatgatttcttgtgaatatttgttatatgtcttctgttacctttcctctcccggaattgagcaacctacacactcacatgtttactggtagatatgtttaaaagcaaataaaggtattggtatatattgcttcaaaaaaaaaaaaaaaaaaaaaaactcgag

SEQ ID NO: 26 - DNA, 493 bp, Homo sapien
gaggcgagcggcagggcctggtggcgagagcgcggctgtcactgcgcccgagcatcccagagctttccgagcggacgagccggccgtgccgggcatccccagcctcgctaccctcgcagcacacgtcgagccccgcacaggcaagggtccggaacttagcccaaagcacgtttcccctggcagcgcaggagacgcccggccgcgcgccggcgcacgcccccctctcctcctttgttccgggggtcggcggccgctctcctgccagcgtcgggatctcggccccgggaggcgggccgtcgggcgcagccgcgaagattccgttggaactgacgcagagccgagtgcagaagatctgggtgcccgtggaccacaggccctcgttgcccagatcctgtgggccaaagctgaccaactcccccgccgtcttcgtcatggtgggcctcccccgcccggggcaagacctacttctccacgaaagcttactcgctgcctc

SEQ ID NO: 27 - DNA, 1331 bp, Homo sapien
ggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgcttactgcagtgcatggtattcagtcagcttttgatgaagctatgtcatactgtcgatatcatccttccaaagggtattggtggcacttcaaagatcatgaagagcaagataaagtcagacctaaagccaaaaggaaagaagaaccaagctctatttttcagagacaacgtgtggatgctttacttttagacctcagacaaaaatttccacccaaatttgtgcagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggcgggcgcccatagtcccagctactcgggaggctgagacaggagacttgcttgaacccgggaggtggaggttgccctgagctgattatcatgctgttgcactccagcttgggcgacagagcgagactttgtctcaaaaaaagaagaaaagatattattcccatcatgatttcttgtgaatatttgttatatgtcttctgtaacctttcctctcccggacttgagcaacctacacactcacatgtttactggtagatatgtttaaaagcaaaataaaggtattggtataaaaaaaaaaaaaaaaaaactcgag

SEQ ID NO: 28 - DNA, 1333 bp, Homo sapien
cggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgcttactgcagtgcatggtattcagtcagcttttgatgaagctatgtcatactgtcgatatcatccttccaaagggtattggtggcacttcaaagatcatgaagagcaagataaagtcagacctaaagccaaaaggaaagaagaaccaagctctatttttcagagacaacgtgtggatgctttacttttagacctcagacaaaaatttccacccaaatttgtgcagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggcgggcgcccatagtcccagctactcgggaggctgagacaggagacttgcttgaacccgggaggtggaggttgccctgagctgattatcatgctgttgcactccagcttgggcgacagagcgagactttgtctcaaaaaagaagaaaagatattattcccatcatgatttcttgtgaatatttgtgatatgtcttctgtaacctttcctctcccggacttgagcaacctacacactcacatgtttactggtagatatgtttaaaagcaaaataaaggtatttgtataaaaaaaaaaaaaaaaaactcgag

SEQ ID NO: 29 - DNA, 813 bp, Homo sapien
ctgagctgcacttcagcgaattcacctcggctgtggctgacatgaagaactccgtggcggaccgagacaacagccccagctcctgtgctggcctcttcattgcttcacacatcgggtttgactggcccggggtctgggtccacctggacatcgctgctccagtgcatgctggcgagcgagccacaggctttggggtggctctcctactggctctttttggccgtgcctccgaggacccgctgctgaacctggtatccccgctggactgtgaggtggatgcccaggaaggcgacaacatggggcgtgactccaagagacggaggctcgtgtgagggctacttcccagctggtgacacagggttccttacctcattttgcactgactgattttaagcaattgaaagattaactaactcttaagatgagtttggcttctccttctgtgcccagtggtgacaggagtgagccattcttctcttagaagcagcttaggggcttggtggggtctggagaaaattgtcacagaccccataggtctccatctgtaagctctgtcccttgtcctccaccctggtctttagagccacctcaggtcaccctctgtagtgagtgtacttcctgacccaggcccttgctcaagctggggctccctggggtgtctaaccagccctgggtagatgtgactggctgttagggaccccattctgtgaagcaggagaccctcacagctcccaccaacccccagttcacttgaagttgaattaaatatggccacaacataaaaaaaaaaaaaaaaaaaaaaaaaaactcgag

SEQ ID NO: 30 - DNA, 1316 bp, Homo sapien
caggcgcccagtcatggcccaagagacagcaccaccgtgtggcccagtctcaaggggtgacagtccaatcatagaaaagatggaaaaaaggacatgtgccctgtgccctgaaggccacgagtggagtcaaatatacttttcaccatcaggaaatatagttgctcatgaaaactgtttgctgtattcatcaggactggtggagtgtgagactcttgatctacgtaatacaattagaaactttgatgtcaaatctgtaaagaaagagatctggagaggaagaagattgaaatgctcattctgtaacaaaggaggcgccaccgtggggtgtgatttatggttctgtaagaagagttaccactatgtctgtgccaaaaaggaccaagcaattcttcaagttgatggaaaccatggaacttacaaattattttgcccagaacattctccagaacaagaagaggccactgaaagtgctgatgacccaagcatgaagaagaagagaggaaaaaacaaacgcctctcatcaggccctcctgcacagccaaaaacgatgaaatgtagtaacgccaaaagacatatgacagaagagcctcatggtcacacagatgcagctgtcaaatctccttttcttaagaaatgccaggaagcaggacttcttactgaactatttgaacacatactagaaaatatggattcagttcatggaagacttgtggatgagactgcctcagagtcggactatgaagggatcgagaccttactgtttgactgtggattatttaaagacacactaagaaaattccaagaagtaatcaagagtaaagcttgtgaatgggaagaaaggcaaaggcagatgaagcagcagcttgaggcacttgcagacttacaacaaagcttgtgctcatttcaagaaaatggggacctggactgctcaagttctacatcaggatccttgctacctcctgaggaccaccagtaaaagctgttcctcaggaaaactggatggggcctccatgttctccaaggatcgaggaagtcttcctgcctaccctgcccaccccagtcaagggcagcaacaccagagctttgctcagccttaaatggaatcttagagctttctcttgcttctgctactcctacagatggcctcatcatggtctccactcagtattaataactccatcagcatagagcaaactcaacactgtgcattgcacactgttaccatgggtttatgctcactatcatatcacattgccaatatttagcacacttaataaatgcttgtcaaaacccaaaaaaaaaaaaaaaaactcgag

SEQ ID NO: 31 - DNA, 1355 bp, Homo sapien
cggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgcttactgcagtgcatggtattcagtcagcttttgatgaagctatgtcatactgtcgatatcatccttccaaagggtattggtggcacttcaaagatcatgaagagcaagataaagtcagacctaaagccaaaaggaaagaagaaccaagctctatttttcagagacaacgtgtggatgctttacttttagacctcagacaaaaatttccacccaaatttgtgcagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggcgggcgcccatagtcccagctactcgggaggctgagacaggagacttgcttgaacccgggaggtggaggttgccctgagctgattatcatgctgttgcactccagcttgggcgacagaacgagactttgtctcaaaaaaagaagaaaagatattattcccatcatgatttcttgtgaatatttgttatatgtcttctggtaacctttcctctcccggacttgaagcaacctcacacactcacatgtttactggtagatatgttttaaaagcaaaataaaggtatttgtttttccaaaaaaaaaaaaaaaaaaaaaaaaaaaaaaactcgag

SEQ ID NO: 32 - protein, 80 aa, Homo sapien
VSRIRGGAKKRKKKSYTTPKKDKHQRKKVQPAVLKYYKVDENGKISCLRRECPSDECGAGVFMASHFDRHYCGKCCLTHC

SEQ ID NO: 33 - protein, 130 aa, Homo sapien
EISNEVRKFRTLTELILDAQEHVKNPYKGKKLKKHPDFPKKPLTPYFRFFMEKRAKYAKLHPQMSNLDLTKILSKKYKELPEKKKMKYVPDFQRRETGVRAKPGPIQGGSPPPYPECQESDIPEKPQDPP

SEQ ID NO: 34 - protein, 506 aa, Homo sapien
NSEKEIPVLNELPVPMVARYIRINPQSWFDNGSICMRMEILGCPLPDPNNYYHRRNEMTTTDDLDFKHHNYKEMRQLMKVVNEMCPNITRIYNIGKSHQGLKLYAVEISDHPGEHEVGEPEFHYIAGAHGNEVLGRELLLLLLHFLCQEYSAQNARIVRLVEETRIHILPSLNPDGYEKAYEGGSELGGWSLGRWTHDGIDINNNFPDLNSLLWEAEDQQNAPRKVPNHYIAIPEWFLSENATVATETRAVIAWMEKIPFVLGGNLQGGELVVAYPYDMVRSLWKTQEHTPTPDDHVFRWLAYSYASTHRLMTDARRRVCHTEDFQKEEGTVNGASWHTVAGSLNDFSYLHTNCFELSIYVGCDKYPHESELPEEWENNRESLIVFMEQVHRGIKGIVRDLQGKGISNAVISVEGVNHDIRTASDGDYWRLLNPGEYVVTAKAEGFITSTKNCMVGYDMGATRCDFTLTKTNLARIREIMETFGKQPVSLPSRRLKLRGRKRRQRG

SEQ ID NO: 35 - protein, 96 aa, Homo sapien
MNGEADCPTDLEMAAPRGQDRWSQEDMLTLLECMKNNLPSNDSSQFKTTQTHMDREKVALKDFSGDMCKLKWVEISNEVRKFRTLTELILDTQEHV

SEQ ID NO: 36 - protein, 129 aa, Homo sapien
GIVVFSLGSMVSEIPEKKAVAIADALGKIPQTVLWRYTGTRPSNLANNTILVQWLPQNDLLGHPMTRAFITHASSHGVNESICNGVPMVMIPLFGDQMDNAKRRETKGAGVTLNVLEMTSEDLEDALKS

SEQ ID NO: 37 - protein, 238 aa, Homo sapien
NLLGISWVDSSWIPILNSGSVLDYFSERSNPFYDRTCNNEVVKMQRLTLEHLNQMVGIEYILLHAQEPILFIIRKQQRQSPAQVIPLADYYIIAGVIYQAPDLGSVINSRVLTAVHGIQSAFDEAMSYCRYHPSKGYWWHFKDHEEQDKVRPKAKRKEEPSSIFQRQRVDALLLDLRQKFPPKFVQLKPGEKPVPVDQTKKEAEPIPETVKPEEKETTKNVQQTVSAKGPPEKRMRLQ

SEQ ID NO: 38 - protein, 202 aa, Homo sapien
KGSEGENPLTVPGREKEGMLMGVKPGEDASGPAEDLVRRSEKDTAAVVSRQGSSLNLFEDVQITEPEAEPESKSEPRPPISSPRAPQTRAVKPRLHPVKPMNATATKVANCSLGTATIIGENLNNEVMMKKYSPSDPAFAYAQLTHDELIQLVLKQKETISKKEFQVRELEDYIDNLLVRVMEETPNILRIPTQVGKKAGKM

SEQ ID NO: 39 - protein, 243 aa, Homo sapien
VNALGIMAAVDIRDNLLGISWVDSSWIPILNSGSVLDYFSERSNPFYDRTCNNEVVKMQRLTLEHLNQMVGIEYILLHAQEPILFIIRKQQRQSPAQVIPLADYYIIAGVIYQAPDLGSVINSRVLTAVHGIQSAFDEAMSYCRYHPSKGYWWHFKDHEEQDKVRPKAKRKEEPSSIFQRQRVDALLLDLRQKISTQICAVDQTKKEAEPIPETVKPEEKETTKNVQQTVSAKGPPEKRMRLQ

SEQ ID NO: 40 - protein, 245 aa, Homo sapien
AAVDIRDNLLGISWVDSSWIPILNSGSVLDYFSERSNPFYDRTCNNEVVKMQRLTLEHLNQMVGIEYILLHAQEPILFIIRKQQRQSPAQVIPLADYYIIAGVIYQAPDLGSVINSRVLTAVHGIQSAFDEAMSYCRYHPSKGYWWHFKDHEEQDKVRPKAKRKEEPSSIFQRQRVDALLLDLRQKFPPKFVQLKPGEKPVPVDQTKKEAEPIPETVKPEEKETTKNVQQTVSAKGPPEKRMRLQ

SEQ ID NO: 41 - protein, 163 aa, Homo sapien
GERQGLVARARLSLRPSIPELSERTSRPCRASPASLPSQHTSSPAQARVRNLAQSTFPLAAQETPGRAPAHAPLSSFVPGVGGRSPASVGISAPGGGPSGAAAKIPLELTQSRVQKIWVPVDHRPSLPRSCGPKLTNSPAVFVMVGLPRPGQDLLLHESLLAA

SEQ ID NO: 42 - protein, 243 aa, Homo sapien
VDIRDNLLGISWVDSSWIPILNSGSVLDYFSERSNPFYDRTCNNEVVKMQRLTLEHLNQMVGIEYILLHAQEPILFIIRKQQRQSPAQVIPLADYYIIAGVIYQAPDLGSVINSRVLTAVHGIQSAFDEAMSYCRYHPSKGYWWHFKDHEEQDKVRPKAKRKEEPSSIFQRQRVDALLLDLRQKFPPKFVQLKPGEKPVPVDQTKKEAEPIPETVKPEEKETTKNVQQTVSAKGPPEKRMRLQ

SEQ ID NO: 43 - protein, 244 aa, Homo sapien
AVDIRDNLLGISWVDSSWIPILNSGSVLDYFSERSNPFYDRTCNNEVVKMQRLTLEHLNQMVGIEYILLHAQEPILFIIRKQQRQSPAQVIPLADYYIIAGVIYQAPDLGSVINSRVLTAVHGIQSAFDEAMSYCRYHPSKGYWWHFKDHEEQDKVRPKAKRKEEPSSIFQRQRVDALLLDLRQKFPPKFVQLKPGEKPVPVDQTKKEAEPIPETVKPEEKETTKNVQQTVSAKGPPEKRMRLQ

SEQ ID NO: 44 - protein, 109 aa, Homo sapien
ELHFSEFTSAVADMKNSVADRDNSPSSCAGLFIASHIGFDWPGVWVHLDIAAPVHAGERATGFGVALLLALFGRASEDPLLNLVSPLDCEVDAQEGDNMGRDSKRRRLV

SEQ ID NO: 45 - protein, 324 aa, Homo sapien
RRPVMAQETAPPCGPVSRGDSPIIEKMEKRTCALCPEGHEWSQIYFSPSGNIVAHENCLLYSSGLVECETLDLRNTIRNFDVKSVKKEIWRGRRLKCSFCNKGGATVGCDLWFCKKSYHYVCAKKDQAILQVDGNHGTYKLFCPEHSPEQEEATESADDPSMKKKRGKNKRLSSGPPAQPKTMKCSNAKRHMTEEPHGHTDAAVKSPFLKKCQEAGLLTELFEHILENMDSVHGRLVDETASESDYEGIETLLFDCGLFKDTLRKFQEVIKSKACEWEERQRQMKQQLEALADLQQSLCSFQENGDLDCSSSTSGSLLPPEDHQ

SEQ ID NO: 46 - protein, 244 aa, Homo sapien; identical to SEQ ID NO: 43

SEQ ID NO: 47 - DNA, 14 bp, Homo sapien
ttttttttttttag

SEQ ID NO: 48 - DNA, 10 bp, Homo sapien
cttcaacctc

SEQ ID NO: 49 - DNA, 496 bp, Homo sapien
gcaccatgtaccgagcacttcggctcctcgcgcgctcgcgtcccctcgtgcgggctccagccgcagccttagcttcggctcccggcttgggtggcgcggccgtgccctcgttttggcctccgaacgcggctcgaatggcaagccaaaattccttccggatagaatatgatacctttggtgaactaaaggtgccaaatgataagtattatggcgcccagaccgtgagatctacgatgaactttaagattggaggtgtgacagaacgcatgccaaccccagttattaaagcttttggcatcttgaagcgagcggccgctgaagtaaaccaggattatggtcttgatccaaagattgctaatgcaataatgaaggcagcagatgaggtagctgaaggtaaattaaatgatcattttcctctcgtggtatggcagactggatcaggaactcagacaaatatgaatgtaaatgaagtcattagccaatagagcaattgaaa

SEQ ID NO: 50 - DNA, 499 bp, Homo sapien
agaaaaagtctatgtttgcagaaatacagatccaagacaaagacaggatgggcactgctggaaaagttattaaatgcaaagcagctgtgctttgggagcagaagcaacccttctccattgaggaaatagaagttgccccaccaaagactaaagaagttcgcattaagattttggccacaggaatctgtcgcacagatgaccatgtgataaaaggaacaatggtgtccaagtttccagtgattgtgggacatgaggcaactgggattgtagagagcattggagaaggagtgactacagtgaaaccaggtgacaaagtcatccctctctttctgccacaatgtagagaatgcaatgcttgtcgcaacccagatggcaacctttgcattaggagcgatattactggtcgtggagtactggctgatggcaccaccagatttacatgcaagggcgaaccagtccaccacttcatgaacaccagtacatttaccgagtacacagt

SEQ ID NO: 51 - DNA, 887 bp, Homo sapien
gagtctgagcagaaaggaaaagcagccttggcagccacgttagaggaatacaaagccacagtggccagtgaccagatagagatgaatcgcctgaaggctcagctggagaatgaaaagcagaaagtggcagagctgtattctatccataactctggagacaaatctgatattcaggacctcctggagagtgtcaggctggacaaagaaaaagcagagactttggctagtagcttgcaggaagatctggctcatacccgaaatgatgccaatcgattacaggatgccattgctaaggtagaggatgaataccgagccttccaagaagaagctaagaaacaaattgaagatttgaatatgacgttagaaaaattaagatcagacctggatgaaaaagaaacagaaaggagtgacatgaaagaaaccatctttgaacttgaagatgaagtagaacaacatcgtgctgtgaaacttcatgacaacctcattatttctgatctagagaatacagttaaaaaactccaggaccaaaagcacgacatggaaagagaaataaagacactccacagaagacttcgggaagaatctgcggaatggcggcagtttcaggctgatctccagactgcagtagtcattgcaaatgacattaaatctgaagcccaagaggagattggtgatctaaagcgccggttacatgaggctcaagaaaaaaatgagaaactcacaaaagaattggaggaaataaagtcacgcaagcaagaggaggagcgaggcgggtatacaattacatgaatgccgttgagagagatttggcagccttaaggcagggaatgggactgagtagaaggtcctcgacttcctcagagccaactcctacagtaaaaaccctc

SEQ ID NO: 52 - DNA, 491 bp, Homo sapien
ggcacgagcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccaggcagaaaataaggcagagtctgaagaaatggagacctctcaagctggatccaaggataaaaagatggaccaaccaccccaagccaagaaggcaaaagtgaagaccagtactgtggacctgg

SEQ ID NO: 53 - DNA, 787 bp, Homo sapien
aagcagttgagtaggcagaaaaaagaacctcttcattaaggattaaaatgtataggccagcacgtgtaacttcgacttcaagatttctgaatccatatgtagtatgtttcattgtcgtcgcaggggtagtgatcctggcagtcaccatagctctacttgtttactttttagcttttgatcaaaaatcttacttttataggagcagttttcaactcctaaatgttgaatataatagtcagttaaattcaccagctacacaggaatacaggactttgagtggaagaattgaatctctgattactaaaacattcaaagaatcaaatttaagaaatcagttcatcagagctcatgttgccaaactgaggcaagatggtagtggtgtgagagcggatgttgtcatgaaatttcaattcactagaaataacaatggagcatcaatgaaaagcagaattgagtctgttttacgacaaatgctgaataactctggaaacctggaaataaacccttcaactgagataacatcacttactgaccaggctgcagcaaattggcttattaatgaatgtggggccggtccagacctaataacattgtctgagcagagaatccttggaggcactgaggctgaggagggaagctggccgtggcaagtcagtctgcggctcaataatgcccaccactgtggaggcagcctgatcaataacatgtggatcctgacagcagctcactgcttcagaagcaactctaatcctcgtgactggattgccacgtctggtatttccacaac

SEQ ID NO: 54 - DNA, 386 bp, Homo sapien
ggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatga

SEQ ID NO: 55 - DNA, 1462 bp, Homo sapien
aagcagttgagtaggcagaaaaaagaacctcttcattaaggattaaaatgtataggccagcacgtgtaacttcgacttcaagatttctgaatccatatgtagtatgtttcattgtcgtcgcaggggtagtgatcctggcagtcaccatagctctacttgtttactttttagcttttgatcaaaaatcttacttttataggagcagttttcaactcctaaatgttgaatataatagtcagttaaattcaccagctacacaggaatacaggactttgagtggaagaattgaatctctgattactaaaacattcaaagaatcaaatttaagaaatcagttcatcagagctcatgttgccaaactgaggcaagatggtagtggtgtgagagcggatgttgtcatgaaatttcaattcactagaaataacaatggagcatcaatgaaaagcagaattgagtctgttttacgacaaatgctgaataactctggaaacctggaaataaacccttcaactgagataacatcacttactgaccaggctgcagcaaattggcttattaatgaatgtggggccggtccagacctaataacattgtctgagcagagaatccttggaggcactgaggctgaggagggaagctggccgtggcaagtcagtctgcggctcaataatgcccaccactgtggaggcagcctgatcaataacatgtggatcctgacagcagctcactgcttcagaagcaactctaatcctcgtgactggattgccacgtctggtatttccacaacatttcctaaactaagaatgagagtaagaaatattttaattcataacaattataaatctgcaactcatgaaaatgacattgcacttgtgagacttgagaacagtgtcacctttaccaaagatatccatagtgtgtgtctcccagctgctacccagaatattccacctggctctactgcttatgtaacaggatggggcgctcaagaatatgctggccacacagttccagagctaaggcaaggacaggtcagaataataagtaatgatgtatgtaatgcaccacatagttataatggagccatcttgtctggaatgctgtgtgctggagtacctcaaggtggagtggacgcatgtcagggtgactctggtggcccactagtacaagaagactcacggcggctttggtttattgtggggatagtaagctggggagatcagtgtggcctgccggataagccaggagtgtatactcgagtgacagcatacattgactggattaggcaacaaactgggatctagtgcaacaagtgcatccctgttgcaaagtctgtatgcaggtgtgcctgtcttaaattccaaagctttacatttcaactgaaaaagaaactagaaatgtcctaatttaacatcttgttacataaatatggtttaacaaaaaaaaaaaaaaaaaactcgag

SEQ ID NO: 56 - protein, 159 aa, Homo sapien
TMYRALRLLARSRPLVRAPAAALASAPGLGGAAVPSFWPPNAARMASQNSFRIEYDTFGELKVPNDKYYGAQTVRSTMNFKIGGVTERMPTPVIKAFGILKRAAAEVNQDYGLDPKIANAIMKAADEVAEGKLNDHFPLVVWQTGSGTQTNMNVNEVIS

SEQ ID NO: 57 - protein, 165 aa, Homo sapien
KKSMFAEIQIQDKDRMGTAGKVIKCKAAVLWEQKQPFSIEEIEVAPPKTKEVRIKILATGICRTDDHVIKGTMVSKFPVIVGHEATGIVESIGEGVTTVKPGDKVIPLFLPQCRECNACRNPDGNLCIRSDITGRGVLADGTTRFTCKGEPVHHFMNTSTFTEYT

SEQ ID NO: 58 - protein, 259 aa, Homo sapien
ESEQKGKAALAATLEEYKATVASDQIEMNRLKAQLENEKQKVAELYSIHNSGDKSDIQDLLESVRLDKEKAETLASSLQEDLAHTRNDANRLQDAIAKVEDEYRAFQEEAKKQIEDLNMTLEKLRSDLDEKETERSDMKETIFELEDEVEQHRAVKLHDNLIISDLENTVKKLQDQKHDMEREIKTLHRRLREESAEWRQFQADLQTAVVIANDIKSEAQEEIGDLKRRLHEAQEKNEKLTKELEEIKSRKQEEERGGY

SEQ ID NO: 59 - protein, 125 aa, Homo sapien
GTSFSKNHAAPFSKVLTFYRKEPFTLEAYYSSPQDLPYPDPAIAQFSVQKVTPQSDGSSSKVKVKVRVNVHGIFSVSSASLVEVHKSEENEEPMETDQNAKEEEKMQVDQEEPHVEEQQQQTPGR

SEQ ID NO: 60 - protein, 246 aa, Homo sapien
MYRPARVTSTSRFLNPYVVCFIVVAGVVILAVTIALLVYFLAFDQKSYFYRSSFQLLNVEYNSQLNSPATQEYRTLSGRIESLITKTFKESNLRNQFIRAHVAKLRQDGSGVRADVVMKFQFTRNNNGASMKSRIESVLRQMLNNSGNLEINPSTEITSLTDQAAANWLINECGAGPDLITLSEQRILGGTEAEEGSWPWQVSLRLNNAHHCGGSLINNMWILTAAHCFRSNSNPRDWIATSGIST

SEQ ID NO: 61 - protein, 128 aa, Homo sapien
GIFSVSSASLVEVHKSEENEEPMETDQNAKEEEKMQVDQEEPHVEEQQQQTPAENKAESEEMETSQAGSKDKKMDQPPQAKKAKVKTSTVDLPIENQLLWQIDREMLNLYIENEGKMIMQDKLEKERN

SEQ ID NO: 62 - protein, 418 aa, Homo sapien
MYRPARVTSTSRFLNPYVVCFIVVAGVVILAVTIALLVYFLAFDQKSYFYRSSFQLLNVEYNSQLNSPATQEYRTLSGRIESLITKTFKESNLRNQFIRAHVAKLRQDGSGVRADVVMKFQFTRNNNGASMKSRIESVLRQMLNNSGNLEINPSTEITSLTDQAAANWLINECGAGPDLITLSEQRILGGTEAEEGSWPWQVSLRLNNAHHCGGSLINNMWILTAAHCFRSNSNPRDWIATSGISTTFPKLRMRVRNILIHNNYKSATHENDIALVRLENSVTFTKDIHSVCLPAATQNIPPGSTAYVTGWGAQEYAGHTVPELRQGQVRIISNDVCNAPHSYNGAILSGMLCAGVPQGGVDACQGDSGGPLVQEDSRRLWFIVGIVSWGDQCGLPDKPGVYTRVTAYIDWIRQQTGI

SEQ ID NO: 63 - DNA, 776 bp, Homo sapien
cacagatggtgatagaggaatccatcttgcagtcagataaagccctcactgatagagagaaggcagtagcagtggatcgggccaagaaggaggcagctgagaaggaacaggaacttttaaaacagaaattacaggagcagccagcaacagatggaggctcaagataagagtcgcaaggaaaactagccaactgaaggagaagctgcagatggagagagaacacctactgagagagcagattatgatgttggagcacacgcagaaggtccaaaatgattggcttcatgaaggatttaagaagaagtatgaggagatgaatgcagagataagtcaatttaaacgtatgattgatactacaaaaaatgatgatactccctggattgcacgaaccttggacaaccttgccgatgagctaactgcaatattgtctgctcctgctaaattaattggtcatggtgtcaaaggtgtgagctcactctttaaaaagcataagctccccttttaaggatattatagattgtacatatatgctttggactatttttgatctgtatgtttttcattttcattcagcaagttttttttttttttcagagtcttactctgttgcccaggctggagtacagtggtgcaatctcagctcactgcaacctctgcctcctgggttcaagagattcacctgcctcagccccctagtagctgggattataggtgtacaccaccacacccagctaatttttgtatttttagtagagatggggtttcactatgttggc

SEQ ID NO: 64 - DNA, 160 bp, Homo sapien
gcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccga

SEQ ID NO: 65 - protein, 72 aa, Homo sapien
LSAMGFTAAGIASSSIAAKMMSAAAIANGGGVASGSLVATLQSLGATGLSGLTKFILGSIGSAIAAVIARFY

SEQ ID NO: 66 - DNA, 2581 bp, Homo sapien
ctttcaacccgcgctcgccggctccagccccgcgcgcccccaccccttgccctcccggcggctccgcagggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgccactacgaaggaggtgaaggactccctggggaagcagtggtctcagctctcggacaaaaagaggctgaaatggattcataaggccctggagcagcggaaggagtacgaggagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctccttaggggactcctcagactttgactccaactgaggcttagccccaccccaggggagccagggagagcccaggagctcccctccccaactgaccacctttgtttcttccccatgttctgtcccttgcccccctggcctcccccactttctttctttctttaaaaaaaaaaaaaaaaaactcgag

SEQ ID NO: 67 - protein, 764 aa, Homo sapien
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDATTKEVKDSLGKQWSQLSDKKRLKWIHKALEQRKEYEEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQATSPASKKPAQEGGKGGSEKPKRPVSAMFIFSEEKRRQLQEERPELSESELTRLLARMWNDLSEKKKAKYKAREAALKAQSERKPGGEREERGKLPESPKRAEEIWQQSVIGDYLARFKNDRVKALKAMEMTWNNMEKKEKLMWIKKAAEDQKRYERELSEMRAPPAATNSSKKMKFQGEPKKPPMNGYQKFSQELLSNGELNHLPLKERMVEIGSRWQRISQSQKEHYKKLAEEQQKQYKVHLDLWVKSLSPQDRAAYKEYISNKRKSMTKLRGPNPKSSRTTLQSKSESEEDDEEDEDDEDEDEEEEDDENGDSSEDGGDSSESSSEDESEDGDENEEDDEDEDDDEDDDEDEDNESEGSSSSSSSLGDSSDFDSN

SEQ ID NO: 68 - DNA, 434 bp, Homo sapien
ctaagatgctggatgctgaagacatcgtcggaactgcccggccagatgagaaagccattatgacttatgtgtctagcttctatcatgccttctctggagcccagaaggcagaaacagcagccaatcgcatctgcaaagtgttggcggtcaatcaagagaacgagcagcttatggaagactatgagaagctggccagtgatctgttggagtggatccgccgcaccatcccatggctggagaatcgggtgcctgagaacaccatgcatgccatgcagcagaagctggaggacttccgagactatagacgcctgcacaagccgcccaaggtgcaggagaagtgccagctggagatcaactttaacacgctgcagaccaaactgcggctcagcaaccggcctgccttcatgccctccgagggcaggatggtctcggat

SEQ ID NO: 69 - DNA, 244 bp, Homo sapien
aggcagcatgctcgttgagagtcatcaccactccctaatctcaagtacgcagggacacaaacactgcggaaggccgcagggtcctctgcctaggaaaaccagagacctttgttcacttgtttatgtgctgaccttccctccactattgtcctgtgaccctgccaaatccccctttgtgagaaacacccaagaatgatcaataaaaaataaattaatttaggaaaaaaaaaaaaaaaaactcgag

SEQ ID NO: 70 - DNA, 437 bp, Homo sapien
ctgggacgggagcgtccagcgggactcgaaccccagatgtgaaggcgtttctggaaagtccttggtccctggatccagcgtcggccagcccagagcccgtgccgcacatccttgcgtcctccaggcagtgggaccccgcgagctgcacgtccctgggcacggacaagtgtgaggcactgttggggctgtgccaggtgcggggtgggctgccccctttctcagaaccttccagcctggtgccgtggcccccaggccggagtcttcctaaggctgtgaggccacccctgtcctggcctccgttctcgcagcagcagaccttgcccgtgatgagcggggaggcccttggctggctgggccaggctggttccctggccatgggggctgcacctctgggggagccagccaaggaggaccccatgctggcgcaggaagccggg

SEQ ID NO: 71 - DNA, 271 bp, Homo sapien
gcgcagagttctgtcgtccaccatcgagtgaggaagagagcattggttcccctgagatagaagagatggctctcttcagtgcccagtctccatacattaacccgatcatcccctttactggaccaatccaaggagggctgcaggagggacttcaggtgaccctccaggggactaccgagagttttgcacaaaagtttgtggtgaacttttcagaacagcttcaatggagatgacttggccttccacttcaaccccggttatgaggaaggag

SEQ ID NO: 72 - DNA, 290 bp, Homo sapien
ccgagccctacccggaggtctccagaatccccaccgtcaggggatgcaacggctccctgtctggtgccctctcctgctgcgaggactcggcccagggctcgggcccgcccaaggcccctacggtggccgagggtcccagctcctgccttcggcggaacgtgatcagcgagagggagcgcaggaagcggatgtcgttgagctgtgagcgtctgcgggccctgctgccccagttcgatggccggcgggaggacatggcctcggtcctggagatgtctgttgcaattcctgcg

SEQ ID NO: 73 - protein, 144 aa, Homo sapien
KMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSD

SEQ ID NO: 74 - protein, 64 aa, Homo sapien
GSMLVESHHHSLISSTQGHKHCGRPQGPLPRKTRDLCSLVYVLTFPPLLSCDPAKSPFVRNTQE

SEQ ID NO: 75 - protein, 145 aa, Homo sapien
GTGASSGTRTPDVKAFLESPWSLDPASASPEPVPHILASSRQWDPASCTSLGTDKCEALLGLCQVRGGLPPFSEPSSLVPWPPGRSLPKAVRPPLSWPPFSQQQTLPVMSGEALGWLGQAGSLAMGAAPLGEPAKEDPMLAQEAG

SEQ ID NO: 76 - protein, 69 aa, Homo sapien
AEFCRPPSSEEESIGSPEIEEMALFSAQSPYINPIIPFTGPIQGGLQEGLQVTLQGTTESFAQKFVVNF

SEQ ID NO: 77 - protein, 96 aa, Homo sapien
EPYPEVSRIPTVRGCNGSLSGALSCCEDSAQGSGPPKAPTVAEGPSSCLRRNVISERERRKRMSLSCERLRALLPQFDGRREDMASVLEMSVAIPA

SEQ ID NO: 78 - DNA, 2076 bp, Homo sapien
agaaaaagtctatgtttgcagaaatacagatccaagacaaagacaggatgggcactgctggaaaagttattaaatgcaaagcagctgtgctttgggagcagaagcaacccttctccattgaggaaatagaagttgccccaccaaagactaaagaagttcgcattaagattttggccacaggaatctgtcgcacagatgaccatgtgataaaaggaacaatggtgtccaagtttccagtgattgtgggacatgaggcaactgggattgtagagagcattggagaaggagtgactacagtgaaaccaggtgacaaagtcatccctctctttctgccacaatgtagagaatgcaatgcttgtcgcaacccagatggcaacctttgcattaggagcgatattactggtcgtggagtactggctgatggcaccaccagatttacatgcaagggcaaaccagtccaccacttcatgaacaccagtacatttaccgagtacacagtggtggatgaatcttctgttgctaagattgatgatgcagctcctcctgagaaagtctgtttaattggctgtgggttttccactggatatggcgctgctgttaaaactggcaaggtcaaacctggttccacttgcgtcgtctttggcctgagaggagttggcctgtcagtcatcatgggctgtaagtcagctggtgcatctaggatcattgggattgacctcaacaaagacaaatttgagaaggccatggctgtaggtgccactgagtgtatcagtcccaaggactctaccaaacccatcagtgaggtgctgtcagaaatgacaggcaacaacgtgggatacacctttgaagttattgggcatcttgaaaccatgattgatgccctggcatcctgccacatgaactatgggaccagcgtggttgtaggagttcctccatcagccaagatgctcacctatgacccgatgttgctcttcactggacgcacatggaagggatgtgtctttggaggtttgaaaagcagagatgatgtcccaaaactagtgactgagttcctggcaaagaaatttgacctggaccagttgataactcatgtcttaccatttaaaaaaatcagtgaaggatttgagctgctcaattcaggacaaagcattcgaacggtcctgacgttttgagatccaaagtggcaggaggtctgtgttgtcatggtgaactggagtttctcttgtgagagttccctcatctgaaatcatgtatctgtctcacaaatacaagcataagtagaagatttgttgaagacatagaacccttataaagaattattaacctttataaacatttaaagtcttgtgagcacctgggaattagtataataacaatgttaatatttttgatttacattttgtaaggctataattgtatcttttaagaaaacatacacttggatttctatgttgaaatggagatttttaagagttttaaccagctgctgcagatatatatctcaaaacagatatagcgtataaagatatagtaaatgcatctcctagagtaatattcacttaacacattgaaactattattttttagatttgaatataaatgtattttttaaacacttgttatgagttaacttggattacattttgaaatcagttcattccatgatgcatattactggattagattaagaaagacagaaaagattaagggacgggcacatttttcaacgattaagaatcatcattacataacttggtgaaactgaaaaagtatatcatatgggtacacaaggctatttgccagcatatattaatattttagaaaatattccttttgtaatactgaatataaacatagagctagaatcatattatcatacttatcataatgttcaatttgatacagtagaattgcaagtccttaagtccctattcactgtgcttagtagtgactccatttaataaaaagtgtttttagtttttaacaactacactgatgtatttatatatatttataacatgttaaaaatttttaaggaaattaaaaattatataaaaaaaaaaaaaaaaactcgag

SEQ ID NO: 79 - DNA, 2790 bp, Homo sapien
aagcagttgagtaggcagaaaaaagaacctcttcattaaggattaaaatgtataggccagcacgtgtaacttcgacttcaagatttctgaatccatatgtagtatgtttcattgtcgtcgcaggggtagtgatcctggcagtcaccatagctctacttgtttactttttagcttttgatcaaaaatcttacttttataggagcagttttcaactcctaaatgttgaatataatagtcagttaaattcaccagctacacaggaatacaggactttgagtggaagaattgaatctctgattactaaaacattcaaagaatcaaatttaagaaatcagttcatcagagctcatgttgccaaactgaggcaagatggtagtggtgtgagagcggatgttgtcatgaaatttcaattcactagaaataacaatggagcatcaatgaaaagcagaattgagtctgttttacgacaaatgctgaataactctggaaacctggaaataaacccttcaactgagataacatcacttactgaccaggctgcagcaaattggcttattaatgaatgtggggccggtccagacctaataacattgtctgagcagagaatccttggaggcactgaggctgaggagggaagctggccgtggcaagtcagtctgcggctcaataatgcccaccactgtggaggcagcctgatcaataacatgtggatcctgacagcagctcactgcttcagaagcaactctaatcctcgtgactggattgccacgtctggtatttccacaacatttcctaaactaagaatgagagtaagaaatattttaattcataacaattataaatctgcaactcatgaaaatgacattgcacttgtgagacttgagaacagtgtcacctttaccaaagatatccatagtgtgtgtctcccagctgctacccagaatattccacctggctctactgcttatgtaacaggatggggcgctcaagaatatgctggccacacagttccagagctaaggcaaggacaggtcagaataataagtaatgatgtatgtaatgcaccacatagttataatggagccatcttgtctggaatgctgtgtgctggagtacctcaaggtggagtggacgcatgtcagggtgactctggtggcccactagtacaagaagactcacggcggctttggtttattgtggggatagtaagctggggagatcagtgtggcctgccggataagccaggagtgtatactcgagtgacagcctaccttgactggattaggcaacaaactgggatctagtgcaacaagtgcatccctgttgcaaagtctgtatgcaggtgtgcctgtcttaaattccaaagctttacatttcaactgaaaaagaaactagaaatgtcctaatttaacatcttgttacataaatatggtttaacaaacactgtttaacctttctttattattaaaggttttctattttctccagagaactatatgaatgttgcatagtactgtggctgtgtaacagaagaaacacactaaactaattacaaagttaacaatttcattacagttgtgctaaatgcccgtagtgagaagaacaggaaccttgagcatgtatagtagaggaacctgcacaggtctgatgggtcagaggggtcttctctgggtttcactgaggatgagaagtaagcaaactgtggaaacatgcaaaggaaaaagtgatagaataatattcaagacaaaaagaacagtatgaggcaagagaaatagtatgtatttaaaatttttggttactcaatatcttatacttagtatgagtcctaaaattaaaaatgtgaaactgttgtactatacgtataacctaaccttaattattctgtaagaacatgcttccataggaaatagtggataattttcagctatttaaggcaaaagctaaaatagttcactcctcaactgagacccaaagaattatagatatttttcatgatgacccatgaaaaatatcactcatctacataaaggagagactatatctattttatagagaagctaagaaatatacctacacaaacttgtcaggtgctttacaactacatagtactttttaacaacaaaataataattttaagaatgaaaaatttaatcatcgggaagaacgtcccactacagacttcctatcactggcagttatatttttgagcgtaaaagggtcgtcaaacgctaaatctaagtaatgaattgaaagtttaaagagggggaagagttggtttgcaaaggaaaagtttaaatagcttaatatcaatagaatgatcctgaagacagaaaaaactttgtcactcttcctctctcattttctttctctctctctccccttctcatacacatgcctccccgaccaaagaatataatgtaaattaaatccactaaaatgtaatggcatgaaaatctctgtagtctgaatcactaatattcctgagtttttatgagctcctagtacagctaaagtttgcctatgcatgatcatctatgcgtcagagcttcctccttctacaagctaactccctgcatctgggcatcaggactgctccatacatttgctgaaaacttcttgtatttcctgatgtaaaattgtgcaaacacctacaataaagccatctacttttagggaaagggagttgaaaatgcaaccaactcttggcgaactgtacaaacaaatctttgctatactttatttcaaataaattctttttgaaatgaaaaaaaaaaaaaaaaaaaactcgag

SEQ ID NO: 80 - DNA, 1460 bp, Homo sapien
ctcaaagcagttgagtaggcagaaaaaagaacctcttcattaaggattaaaatgtataggccagcacgtgtaacttcgacttcaagatttctgaatccatatgtagtatgtttcattgtcgtcgcaggggtagtgatcctggcagtcaccatagctctacttgtttactttttagcttttgatcaaaaatcttacttttataggagcagttttcaactcctaaatgttgaatataatagtcagttaaattcaccagctacacaggaatacaggactttgagtggaagaattgaatctctgattactaaaacattcaaagaatcaaatttaagaaatcagttcatcagagctcatgttgccaaactgaggcaagatggtagtggtgtgagagcggatgttgtcatgaaatttcaattcactagaaataacaatggagcatcaatgaaaagcagaattgagtctgttttacgacaaatgctgaataactctggaaacctggaaataaacccttcaactgagataacatcacttactgaccaggctgcagcaaattggcttattaatgaatgtggggccggtccagacctaataacattgtctgagcagagaatccttggaggcactgaggctgaggagggaagctggccgtggcaagtcagtctgcggctcaataatgcccaccactgtggaggcagcctgatcaataacatgtggatcctgacagcagctcactgcttcagaagcaactctaatcctcgtgactggattgccacgtctggtatttccacaacatttcctaaactaagaatgagagtaagaaatattttaattcataacaattataaatctgcaactcatgaaaatgacattgcacttgtgagacttgagaacagtgtcacctttaccaaagatatccatagtgtgtgtctcccagctgctacccagaatattccacctggctctactgcttatgtaacaggatggggcgctcaagaatatgctggccacacagttccagagctaaggcaaggacaggtcagaataataagtaatgatgtatgtaatgcaccacatagttataatggagccatcttgtctggaatgctgtgtgctggagtacctcaaggtggagtggacgcatgtcagggtgactctggtggcccactagtacaagaagactcacggcggctttggtttattgtggggatagtaagctggggagatcagtgtggcctgccggataagccaggagtgtatactcgagtgacagcctaccttgactggattaggcaacaaactgggatctagtgcaacaagtgcatccctgttgcaaagtctgtatgcaggtgtgcctgtcttaaattccaaagctttacatttcaactgaaaaagaaactagaaatgtcctaatttaacatcttgttacataaatatggtttaacaaaaaaaaaaaaaaaaaa

SEQ ID NO: 81 - protein, 386 aa, Homo sapien
MFAEIQIQDKDRMGTAGKVIKCKAAVLWEQKQPFSIEEIEVAPPKTKEVRIKILATGICRTDDHVIKGTMVSKFPVIVGHEATGIVESIGEGVTTVKPGDKVIPLFLPQCRECNACRNPDGNLCIRSDITGRGVLADGTTRFTCKGKPVHHFMNTSTFTEYTVVDESSVAKIDDAAPPEKVCLIGCGFSTGYGAAVKTGKVKPGSTCVVFGLRGVGLSVIMGCKSAGASRIIGIDLNKDKFEKAMAVGATECISPKDSTKPISEVLSEMTGNNVGYTFEVIGHLETMIDALASCHMNYGTSVVVGVPPSAKMLTYDPMLLFTGRTWKGCVFGGLKSRDDVPKLVTEFLAKKFDLDQLITHVLPFKKISEGFELLNSGQSIRTVLTF

SEQ ID NO: 82 - protein, 418 aa, Homo sapien
MYRPARVTSTSRFLNPYVVCFIVVAGVVILAVTIALLVYFLAFDQKSYFYRSSFQLLNVEYNSQLNSPATQEYRTLSGRIESLITKTFKESNLRNQFIRAHVAKLRQDGSGVRADVVMKFQFTRNNNGASMKSRIESVLRQMLNNSGNLEINPSTEITSLTDQAAANWLINECGAGPDLITLSEQRILGGTEAEEGSWPWQVSLRLNNAHHCGGSLINNMWILTAAHCFRSNSNPRDWIATSGISTTFPKLRMRVRNILIHNNYKSATHENDIALVRLENSVTFTKDIHSVCLPAATQNIPPGSTAYVTGWGAQEYAGHTVPELRQGQVRIISNDVCNAPHSYNGAILSGMLCAGVPQGGVDACQGDSGGPLVQEDSRRLWFIVGIVSWGDQCGLPDKPGVYTRVTAYLDWIRQQTGI

SEQ ID NO: 83 - protein, 418 aa, Homo sapien; identical to SEQ ID NO: 82

SEQ ID NO: 84 - DNA, 489 bp, Homo sapien
aaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaa

SEQ ID NO: 85 - DNA, 304 bp, Homo sapien
gggacctggaggaggccacgctgcagcatgaagccacagcagccaccctgaggaagaagcacgcggacagcgtggccgagctcggggagcagatcgacaacctgcagcgggtgaagcagaagctggagaaggagaagagcgagatgaagatggagatcgatgacctcgcttgtaacatggaggtcatctccaaatctaagggaaaccttgagaagatgtgccgcacactggaggaccaagtgagtgagctgaagacccaggaggaggaacagcagcggctgatcaatgaactgactgcgcagag

SEQ ID NO: 86 - DNA, 296 bp, Homo sapien
gaaaatccttcctttgaatgggaatctccaagcagttgaattgggcgaaaaaagaacctcttccttaaggattaaaatgtttagggcaacacgtgttacttccacttccagatttctgaatccatatgttgtatgtttccttgtcctcccaggggttgtgatcctggcagtccccatagctctacttgtttactttttagcttttgatcaaaaatcttacttttattggagcaattttccactcccaaatgttgaatataatagtccgtttaattcccccgcttcaccgggaattc

SEQ ID NO: 87 - DNA, 904 bp, Homo sapien
gtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagagttgtccccggttttaaccagtgaagttcatagtgttcgtgcaggacggcatcttgctaccaaattgaatattttagtacagcaacattttgacttggcttcaactactattacaaatattccaatgaaggaagaacagcatgctaacacatctgccaattatgatgtggagctacttcatcacaaagatgcacatgtagatttcctgaaaagtggtgattcgcatctaggtggcggcagtcgagaaggctcgtttaaagaaacaataacattaaagtggtgtacaccaaggacaaataacattgaattacactattgtactggagcttatcggatttcacctgtagatgtaaatagtagaccttcctcctgccttactaattttcttctaaatggtcgttctgttttattggaacaaccacgaaagtcaggttctaaagtcattagtcatatgcttagtagccatggaggagagatttttttgcacgtccttagcagttctcgatccattctagaagatccaccttcaattagtgaaggatgtggaggaagagttacagactaccggattacagattttggtgaatttatgaggggaaaacagattaactccttttctacaccccagatataaaatcgatggaagtcttgaggtccctttggaaccgagccaaaagatcagttaaaaaaacatacccgttactggcctatgatttcaaaaacccaccatttttaacatgcaagcggtagttccgttaacca

SEQ ID NO: 88 - DNA, 387 bp, Homo sapien
cgtctctcccccagtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcgggcctcccccacctccacgctctcacaacatgccttcaa

SEQ ID NO: 89 - DNA, 481 bp, Homo sapien
tgttcttggacctgcggtgctatagagcaggctcttctaggttggcagttgccatggaatctggacccaaaatgttggcccccgtttgcctggtggaaaataacaatgagcagctattggtgaaccagcaagctatacagattcttgaaaagatttctcagccagtggtggtggtggccattgtaggactgtaccgtacagggaaatcctacttgatgaaccatctggcaggacagaatcatggcttccctctgggctccacggtgcagtctgaaaccaagggcatctggatgtggtgcgtgccccacccatccaagccaaaccacaccctggtccttctggacaccgaaggtctgggcgatgtggaaaagggtgaccctaagaatgactcctggatctttgccctggctgtgctcctgtgcagcacctttgtctacaacagcatgagcaccatcaaccaccaggccctggagcagctgca

SEQ ID NO: 90 - DNA, 491 bp, Homo sapien
tgaaaactgttcttggacctgcggtgctatagagcaggttggcagttgccatggaatctggacccaaaatgttggcccccgtttgcctggtggaaaataacaatgagcagctattggtgaaccagcaagctatacagattcttgaaaagatttctcagccagtggtggtggtggccattgtaggactgtaccgtacagggaaatcctacttgatgaaccatctggcaggacagaatcatggcttccctctgggctccacggtgcagtctgaaaccaagggcatctggatgtggtgcgtgccccacccatccaagccaaaccacaccctggtccttctggacaccgaaggtctgggcgatgtggaaaagggtgaccctaagaatgactcctggatctttgccctggctgtgctcctgtgcagcacctttgtctacaacagcatgagcaccatcaaccaccaagccctggagcagctgcattatgtgacggac

SEQ ID NO: 91 - DNA, 488 bp, Homo sapien
ttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcgaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgcccctctgctgatgccccatgttcgtcatgggtgtgaaccatgagaagtatgacacagcctc

SEQ ID NO: 92 - DNA, 384 bp, Homo sapien
gacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcgaggctgagaacgggaagcttgtcatcaatggaaatcccatcaccatcttccaggagcgagatccctccaaaatcaagtggggcgatactggcgctgagtacgtcgtggagtccactggcgtcttcaccaccatggagaaggctgggg

SEQ ID NO: 93 - protein, 162 aa, Homo sapien
KGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVL

SEQ ID NO: 94 - protein, 100 aa, Homo sapien
DLEEATLQHEATAATLRKKHADSVAELGEQIDNLQRVKQKLEKEKSEMKMEIDDLACNMEVISKSKGNLEKMCRTLEDQVSELKTQEEEQQRLINELTAQ

SEQ ID NO: 95 - protein, 99 aa, Homo sapien
KILPLNGNLQAVELGEKRTSSLRIKMFRATRVTSTSRFLNPYVVCFLVLPGVVILAVPIALLVYFLAFDQKSYFYWSNFPLPNVEYNSPFNSPASPGIP

SEQ ID NO: 96 - protein, 257 aa, Homo sapien
VQETIHEHNKLAANSDHLMQIQKCELVLIHTYPVGEDSLVSDRSKKELSPVLTSEVHSVRAGRHLATKLNILVQQHFDLASTTITNIPMKEEQHANTSANYDVELLHHKDAHVDFLKSGDSHLGGGSREGSFKETITLKWCTPRTNNIELHYCTGAYRISPVDVNSRPSSCLTNFLLNGRSVLLEQPRKSGSKVISHMLSSHGGEIFLHVLSSSRSILEDPPSISEGCGGRVTDYRITDFGEFMRGKQINSFSTPQI

SEQ ID NO: 97 - protein, 128 aa, Homo sapien
SLPQFAVHPERSGLADSGDGGNMSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPS

SEQ ID NO: 98 - protein, 159 aa, Homo sapien
FLDLRCYRAGSSRLAVAMESGPKMLAPVCLVENNNEQLLVNQQAIQILEKISQPVVVVAIVGLYRTGKSYLMNHLAGQNHGFPLGSTVQSETKGIWMWCVPHPSKPNHTLVLLDTEGLGDVEKGDPKNDSWIFALAVLLCSTFVYNSMSTINHQALEQL

SEQ ID NO: 99 - protein, 147 aa, Homo sapien
MESGPKMLAPVCLVENNNEQLLVNQQAIQILEKISQPVVVVAIVGLYRTGKSYLMNHLAGQNHGFPLGSTVQSETKGIWMWCVPHPSKPNHTLVLLDTEGLGDVEKGDPKNDSWIFALAVLLCSTFVYNSMSTINHQALEQLHYVTD

SEQ ID NO: 100 - protein, 124 aa, Homo sapien
MGKVKVGVNGFGRIGRLVTRAAFNSGKVDIVAINDPFIDLNYMVYMFQYDSTHGKFHGTVEAENGKLVINGNPITIFQERDPSKIKWGDAGAEYVVESTGVFTTMEKAGAHLQGGAKRVIISAP

SEQ ID NO: 101 - protein, 127 aa, Homo sapien
QSAASSFASPAEPHRSDTMGKVKVGVNGFGRIGRLVTRAAFNSGKVDIVAINDPFIDLNYMVYMFQYDSTHGKFHGTVEAENGKLVINGNPITIFQERDPSKIKWGDTGAEYVVESTGVFTTMEKAG

SEQ ID NO: 102 - DNA, 1225 bp, Homo sapien
atggcggcgcggtcgtcgtcgggggtggcggcggcagagggggcggcggccctggcggcagcggagacggcagccgtgacggtggcagcggcggcgcgggacctgggcctgggggaatgaggcggccgcggcgggccagcggcggagccgtgtagcggagaagctccccctccctgcttcccttggccgagccgggggcgcgcgcgcacgcggccgtccagagcgggctccccacccctcgactcctgcgacccgcaccgcacccccacccgggcccggaggatgatgaagctcaagtcgaaccagacccgcacctacgacggcgacggctacaagaagcgggccgcatgcctgtgtttccgcagcgagagcgaggaggaggtgctactcgtgagcagtagtcgccatccagacagatggattgtccctggaggaggcatggagcccgaggaggagccaagtgtggcagcagttcgtgaagtctgtgaggaggctggagtaaaagggacattgggaagattagttggaatttttgagaaccaggagaggaagcacaggacgtatgtctatgtgctcattgtcactgaagtgctggaagactgggaagattcagttaacattggaaggaagagggaatggtttaaaatagaagacgccataaaagtgctgcagtatcacaaacccgtgcaggcatcatattttgaaacattgaggcaaggctactcagccaacaatggcaccccagtcgtggccaccacatactcggtttctgctcagagctcgatgtcaggcatcagatgactgaagacttcctgtaagagaaatggaaattggaaactagactgaagtgcaaatcttccctctcaccctggctctttccacttctcacaggcctcctctttcaaataaggcatggtgggcagcaaagaaagggtgtattgataatgttgctgtttggtgttaagtgatggggctttttcttctgtttttattgagggtgggggttgggtgtgtaatttgtaagtacttttgtgcatgatctgtccctccctcttcccacccctgcagtcctctgaagagaggccaacagccttcccctgccttggattctgaagtgttcctgtttgtcttatcctggccctggccagacgttttctttgatttttaattttttttttttattaaaagataccagtatgagaaaaaaaaaaaaaaaaaactcgag

SEQ ID NO: 103 - DNA, 741 bp, Homo sapien
agaaacctcaatcggattcagcaaaggaatggtgttattatcactacataccaaatgttaatcaataactggcagcaactttcaagctttaggggccaagagtttgtgtgggactatgtcatcctcgatgaagcacataaaataaaaacctcatctactaagtcagcaatatgtgctcgtgctattcctgcaagtaatcgcctcctcctcacaggaaccccaatccagaataatttacaagaactatggtccctatttgattttgcttgtcaagggtccctgctgggaacattaaaaacttttaagatggagtatgaaaatcctattactagagcaagagagaaggatgctaccccaggagaaaaagccttgggatttaaaatatctgaaaacttaatggcaatcataaaaccctattttctcaggaggactaaagaagacgtacagaagaaaaagtcaagcaacccagaggccagacttaatgaaaagaatccagatgttgatgccatttgtgaaatgccttccctttccaggagaaatgatttaattatttggatacgacttgtgcctttacaagaagaaatatacaggaaatttgtgtctttagatcatatcaaggagttgctaatggagacgcgctcacctttggctgagctaggtgtcttaaagaagctgtgtgatcatcctaggctgctgtctgcacgggcttgttgtttgctaaatcttgggacattctctgct

SEQ ID NO: 104 - DNA, 321 bp, Homo sapien
ttgctctgcgtcatcaaagacaccaaactgctgtgctataaaagttccaaggaccagcagcctcagatggaactgccactccaaggctgtaacattacgtacatcccgaaagacagcaaaaagaagaagcacgagctgaagattactcagcagggcacggacccgcttgttctcgccgtccagagcaaggaacaggccgagcagtggctgaaggtgatcaaagaagcctacagtggttgtagtggccccgtggattcagagtgtcctcctccaccaagctccccggtgcacaaggcagaactggagaagaaactgtcttca

SEQ ID NO: 105 - DNA, 389 bp, Homo sapien
cagcactggccacactataaaattcaggttcagaaaaacagggtaagtcacagacagcaacgcttccagcatttattttctttgcacccatgggcaatttgagaaaatttacctttagaacgaactctgttaaaggtacagacagtacaatactttttattcagaaggtttctgcataaaggtgatagtcttttgacttaatatattattgtctcctgccttgtgtttctggaatgaatgaaggtcattatttagaagataatctgggttgtatttgtgtcgtcagattgaattttcattgcacatgctacttaatgtctttaccaaataataacaaagggaaagaaaaccaaatatagatgtataataaggaaaagctggcctataga

SEQ ID NO: 106 - DNA, 446 bp, Homo sapien
gccacatttgccctggtcatagtttaaacaccaggtcctgtgtcacatctttttggtgccacaagtatcactccattgttcagagagtaatgtattagttctgcccaattcattcttcacttttatttcttccatttcattagcatttatatcagctcaagaagttaaggttagaaaattttccacttcaaattttcagtacagaaatgtgctgtgatgtttgacaagactatttcatagtaagtgagttaatgtttattggcctctgctctcctctgtgtcagacctaggaagcctgaggattacttagttgttctgtctctgggtccacaggcagaatttggcccatccaaagactggccaagtgccaaaaaaaggcctgattaggccctgaaattcagtgaaattctgcctgaagaaacctcttattgaatttgaaaaccata

SEQ ID NO: 107 - DNA, 467 bp, Homo sapien
ccgccgctgccgtcgccttcctgggattggagtctcgagctttcttcgttcgttcgccggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcgatgaagatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgtgcatgtcactataggagacattaaaacgggagcaccacagtatgggagttatggtacagcacctgtaa

SEQ ID NO: 108 - DNA, 491 bp, Homo sapien
gaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctgaggcattttacgctgcgtcattga

SEQ ID NO: 109 - DNA, 489 bp, Homo sapien
ctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtctcgaactcctgacctcaggtgatccactcgcctcggcctcccaaagtgctgggattataggcatgcgccaccatgcccgggc

SEQ ID NO: 110 - DNA, 391 bp, Homo sapien
gcggagtccgctggctgacccgagcgctggtctccgccgggaaccctggggcatggagaggtctgagtacctcggccgcggcgcacgctgcatcgcggagccaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtaatccatgtgaagtcacttcctgggtatatgactcggcacaacaatctagacctggtgatcattcgagagcagacaga

SEQ ID NO: 111 - protein, 172 aa, Homo sapien
MMKLKSNQTRTYDGDGYKKRAACLCFRSESEEEVLLVSSSRHPDRWIVPGGGMEPEEEPSVAAVREVCEEAGVKGTLGRLVGIFENQERKHRTYVYVLIVTEVLEDWEDSVNIGRKREWFKIEDAIKVLQYHKPVQASYFETLRQGYSANNGTPVVATTYSVSAQSSMSGIR

SEQ ID NO: 112 - protein, 247 aa, Homo sapien
RNLNRIQQRNGVIITTYQMLINNWQQLSSFRGQEFVWDYVILDEAHKIKTSSTKSAICARAIPASNRLLLTGTPIQNNLQELWSLFDFACQGSLLGTLKTFKMEYENPITRAREKDATPGEKALGFKISENLMAIIKPYFLRRTKEDVQKKKSSNPEARLNEKNPDVDAICEMPSLSRRNDLIIWIRLVPLQEEIYRKFVSLDHIKELLMETRSPLAELGVLKKLCDHPRLLSARACCLLNLGTFSA

SEQ ID NO: 113 - protein, 107 aa, Homo sapien
LLCVIKDTKLLCYKSSKDQQPQMELPLQGCNITYIPKDSKKKKHELKITQQGTDPLVLAVQSKEQAEQWLKVIKEAYSGCSGPVDSECPPPPSSPVHKAELEKKLSS

SEQ ID NO: 114 - protein, 155 aa, Homo sapien
ERYNFPNPNPFVEDDMDKNEIASVAYRYRRWKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFASQINLSVENA

SEQ ID NO: 115 - protein, 129 aa, Homo sapien
GVRWLTRALVSAGNPGAWRGLSTSAAAHAASRSQAAAVPVEFQEHHLSEVQNMASEEKLEQVLSSMKENKVAIIGKIHTPMEYKGELASYDMRLRRKLDLFANVIHVKSLPGYMTRHNNLDLVIIREQT

SEQ ID NO: 116 - DNA, 550 bp, Homo sapien
gaattcggcaccagcctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccaggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccac

SEQ ID NO: 117 - DNA, 154 bp, Homo sapien
ttctgagggaaagccgagtggagtgggcgacccggcggcggtgacaatgagttttcttggaggcttttttggtcccatttgtgagattgatgttgcccttaatgatggggaaaccaggaaaatggcagaaatgaaaactgaggatggcaaagta

SEQ ID NO: 118 - DNA, 449 bp, Homo sapien
gaattcggcaccagggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcg

SEQ ID NO: 119 - DNA, 642 bp, Homo sapien
gaattcggcacgagcagtaacccgaccgccgctggtcttcgctggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaataaagtgcacgtgtttctggtgaaaaaaaaaaaaaaaaaaaaactcgag

SEQ ID NO: 120 - DNA, 603 bp, Homo sapien
gaattcggcacgagccacaacagccactacgactgcatccactggatccacggccaccccgtcctccaccccgggaacagctccccctcccaaagtgctgaccagcccggccaccacacccatgtccaccatgtccacaatccacacctcctctactccagagaccacccacacctccacagtgctgaccaccacagccaccatgacaagggccaccaattccacggccacaccctcctccactctggggacgacccggatcctcactgagctgaccacaacagccactacaactgcagccactggatccacggccaccctgtcctccaccccagggaccacctggatcctcacagagccgagcactatagccaccgtgatggtgcccaccggttccacggccaccgcctcctccactctgggaacagctcacacccccaaagtggtgaccaccatggccactatgcccacagccactgcctccacggttcccagctcgtccaccgtggggaccacccgcacccctgcagtgctccccagcagcctgccaaccttcagcgtgtccactgtgtcctcctcagtcctcaccaccctgagacccac

SEQ ID NO: 121 - protein, 178 aa, Homo sapien
SEPPSPATTPCGKVPICIPARRDLVDSPASLASSLGSPLPRAKELILNDLPASTPASKSCDSSPPQDASTPRPSSASHLCQLAAKPAPSTDSVALRSPLTLSSPFTTSFSLGSHSTLNGDLSVPSSYVSLHLSPQVSSSVVYGRSPVMAFESHPHLRGSSVSSSLPSIPGGKPAYSFH

SEQ ID NO: 122 - protein, 36 aa, Homo sapien
MSFLGGFFGPICEIDVALNDGETRKMAEMKTEDGKV

SEQ ID NO: 123 - protein, 136 aa, Homo sapien
MASPQLCRALVSAQWVAEALRAPRAGQPLQLLDASWYLPKLGRDARREFEERHIPGAAFFDIDQCSDRTSPYDHMLPGAEHFAEYAGRLGVGAATHVVIYDASDQGLYSAPRVWWMFRAFGHHAVSLLDGGLRHWL

SEQ ID NO: 124 - protein, 133 aa, Homo sapien
MNHTVQTFFSPVNSGQPPNYEMLKEEHEVAVLGAPHNPAPPTSTVIHIRSETSVPDHVVWSLFNTLFMNPCCLGFIAFAYSVKSRDRKMVGDVTGAQAYASTAKCLNIWALILGILMTILLIVIPVLIFQAYG

SEQ ID NO: 125 - protein, 195 aa, Homo sapien
TTATTTASTGSTATPSSTPGTAPPPKVLTSPATTPMSTMSTIHTSSTPETTHTSTVLTTTATMTRATNSTATPSSTLGTTRILTELTTTATTTAATGSTATLSSTPGTTWILTEPSTIATVMVPTGSTATASSTLGTAHTPKVVTTMATMPTATASTVPSSSTVGTTRTPAVLPSSLPTFSVSTVSSSVLTTLRP

SEQ ID NO: 126 - DNA, 509 bp, Homo sapien
gaattcggcacgagccaagtaccccctgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctggagaggagcaccaccccagacattactgggtatagaattaccacaacccctacaaa

SEQ ID NO: 127 - DNA, 500 bp, Homo sapien
gaattcggcacgagccactgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataag

SEQ ID NO: 128 - DNA, 500 bp, Homo sapien
agctttcctctgctgccgctcggtcacgcttgtgcccgaaggaggaaacagtgacagacctggagactgcagttctctatccttcacacagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcaca

SEQ ID NO: 129 - DNA, 497 bp, Homo sapien
gaattcggcacgagcagaggtctccagagccttctctctcctgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgaccgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctgga

SEQ ID NO: 130 - DNA, 383 bp, Homo sapien
gaattcggcacgagggccgcggctgccgactgggtcccctgccgctgtcgccaccatggctccgcaccgccccgcgcccgcgctgctttgcgcgctgtccctggcgctgtgcgcgctgtcgctgcccgtccgcgcggccactgcgtcgcggggggcgtcccaggcgggggcgccccaggggcgggtgcccgaggcgcggcccaacagcatggtggtggaacaccccgagttcctcaaggcagggaaggagcctggcctgcagatctggcgtgtggagaaagttcgatctggtggcccgtgcccaccaacctttatggagacttcttcacgggcgacgcctacgtcatcctgaagacagtgcagcttaagaacggaaaatcttg

SEQ ID NO: 131 - DNA, 509 bp, Homo sapien
gaattcggcacgagagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggccgtcttcaccaccatggagaaggctggggctcatttgcaggggggagccaaaagggtcatcatctctgccccctctgctgacgcccccatgttcgtcatgggtgtgaaccatgagaagtatgacaacagcctcaagatcatc

SEQ ID NO: 132 - DNA, 357 bp, Homo sapien
gaattcggcacgagtaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggacacatcttcagtatctatggtttgaattgggtgcgacaggcccctggtcaaggccttgagtggatgggatggatcaaagtcgacactgcgaacccaacgtatgcccagggcttcacaggacgatttgtcttctccctggacacctctgtcagcacggcatatctgcagatcagca

SEQ ID NO: 133 - DNA, 468 bp, Homo sapien
gaattcggcacgaggcgccccgaaccgtcctcctgctgctctcggcggccctggccctgaccgagacctgggccggctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgct

SEQ ID NO: 134 - DNA, 214 bp, Homo sapien
gaattcggcacgagctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgg

SEQ ID NO: 135 - DNA, 355 bp, Homo sapien
gaattcggcacgaggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgc

SEQ ID NO: 136 - DNA, 242 bp, Homo sapien
gaattcggcacgagccagctcctaaccgcgagtgatccgccagcctccgcctcccgaggtgcccggattgcagacggagtctccttcactcagtgctcaatggtgcccaggctggagtgcagtggtgtgatctcggctcgctacaacatccacctcccagcagcctgccttggcctcccaaagtgccgagattgcagctctctgcccggccgccacccctgtctgggaagtgaggatgctgt

SEQ ID NO: 137 - DNA, 424 bp, Homo sapien
gaattcggcacgagcccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggcc

SEQ ID NO: 138 - DNA, 448 bp, Homo sapien
gaattcggcacgagcctgtgttccaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggccgacaatggagtcaatgaatggtggaaaactctattccaatgcatatctgaatgatttagcaggctgcatcaaaacattgcgctactgtgcaggttg

SEQ ID NO: 139 - DNA, 510 bp, Homo sapien
gaattcggcacgaggttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctggcgaggcgtgcaagaaggtcttcctggactgctgcaactacatcacagagctgcggcggcagcacgcgcgggccagccacctggcctgccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtgagcatgtcggacaagaaagggatctgtgtggcagaccccttcgaggtcacagtaatgcaggacttcttcatcgacctgcggctacccta

SEQ ID NO: 140 - DNA, 360 bp, Homo sapien
gaattcggcacgagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctt

SEQ ID NO: 141 - DNA, 483 bp, Homo sapien
gaattcggcacgagagcagaggctgatctttgctggaaaacagctggaagatgggctgcaccctgtctgactacaacatccagaaagagtccaccctgcacctggtgctccgtctcagaggtgggatgcaaatcttcgtgaagacactcactggcaagaccatcacccttgaggtggagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattcctcctgatcagcagaggttga

SEQ ID NO: 142 - DNA, 500 bp, Homo sapien
gaattcggcacgaggcggcgacgaccgccgggagcgtgtgcagcggcggcggcggaagtggccggcgagcccggtccccgccggcaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgtgtttggtggccggggccgaggtgggatcccgggcacaggcagaagccagccagagaagaagcctggcagacaggcgggca

SEQ ID NO: 143 - DNA, 400 bp, Homo sapien
gaattcggcacgagctcggatgtcagcaggcgtcccaacccagcaggaactggctcaattctcagaagaaagcgatcggccccgaggcaggaaggccggctccggtgcagggcgcgccgcctgcgggctgcttcgggccagggtcgacccgagggccagcgcaagcagcggcaacaggagcgccaggaggacatgaggctctgcctgcagtcagcaacttggaatattcagacttcagaccagcatcacagattataaccctccgtaaatcatctgcatcccagctcccatcaaaagccagcctgaaggacccatggacacgtgactccagtgttctcaacaacatcttagatcaagttggtttgcacaacatttgcatctacttgggacaaagcaagaa

SEQ ID NO: 144 - DNA, 243 bp, Homo sapien
gaattcggcacgagccagctcctaaccgcgagtgatccgccagcctccgcctcccgaggtgcccggattgcagacggagtctccttcactcagtgctcaatggtgcccaggctggagtgcagtggtgtgatctcggctcgctacaacatccacctcccagcagcctgccttggcctcccaaagtgccgagattgcagcctctgcccggccgtcaccccgtctgggaagtgaggagcgtttctg

SEQ ID NO: 145 - DNA, 450 bp, Homo sapien
gaattcggcacgaggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagcctattgactggt

SEQ ID NO: 146 - DNA, 451 bp, Homo sapien
gaattcggcacgagccatcgagtccctgcctttcgacttgcagagaaatgtctcgctgatgcgggagatcgacgcgaaataccaagagatcctgaaggagctagacgagtgctacgagcgcttcagtcgcgagacagacggggcgcagaagcggcggatgctgcactgtgtgcagcgcgcgctgatccgcaccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgacc

SEQ ID NO: 147 - DNA, 400 bp, Homo sapien; identical to SEQ ID NO: 143

SEQ ID NO: 148 - DNA, 503 bp, Homo sapien
aaaagaattcggcacgagcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtc

SEQ ID NO: 149 - DNA, 1061 bp, Homo sapien
gaattcggcacgaggccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccagtactggactgggatgccgctagtgaggctgaggggtgccagcgtgggtgggcttctcaggcaggaggacatcttggcagtgctggcttggccattaaatggaaacctgaaggccatcctctttctgctgtgtgtctgtgtagactgggcacagccctgtggccggggggtcaggtgagtggttgggtgatgggctctgctgacgtgcagggctcagcccagggcatccaggaacaggctccagggcaggaacctgggcccaggagttgcaagtctctgcttcttaccaagcagcagctctgtaccttgggaagtcgcttaattgctctgagcttgtttcctcatctgtcaggagtgccattaaaggagaaaaatcacgtaaaaaaaaaaaaaaaaaaactcgag

SEQ ID NO: 150 - DNA, 781 bp, Homo sapien
gaattcggcacgagaaatggcggcaggggtcgaagcggcagccgaagtggcggcgacagaacccaaaatggaggaagagagcggcgcgccctgcgtgccgagcggcaacggagctccgggcccgaagggtgaagaacgacctactcagaatgagaagaggaaggagaaaaacataaaaagaggaggcaatcgctttgagccatattccaacccaactaaaagatacagagccttcattacaaatataccttttgatgtgaaatggcagtcacttaaagacctggttaaagaaaaagttggtgaggtaacatacgtggagctcttaatggacgctgaaggaaagtcaaggggatgtgctgttgttgaattcaagatggaggagagcatgaaaaaagctgctgaagttctaaacaagcatagtctgagtggaaggccactgaaagtcaaggaagatcctgatggtgaacatgcaaggagagcaatgcaaaaggctggaagacttggaagcacagtatttgtagcaaatctggattataaagttggctggaagaaactgaaggaagtatttagtatggctggtgtggtggtccgagcagacattctggaagataaagatgggaaaagtcgtggaataggcattgtgacttttgaacagtccattgaagctgtgcaagcaatatctatgtttaatggccagttgctgtttgatagaccgatgcacgtcaagatggatgagagggctttaccaaagggagacttttttcctcctgaacgccacagc

SEQ ID NO: 151 - DNA, 3275 bp, Homo sapien
cttaagtggatcctgcatcaggagggagcagacaccggagaaagaaaaacaagttgtgctgtttgaggaagcaagttggacctgcactccagcctgtggagatgaacctaggactgtgattctgctatccagtatgttggctgaccacaggctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgcagcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagttacatgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactcgag

SEQ ID NO: 152 - DNA, 2179 bp, Homo sapien
gaattcggcaccaggcactattaaatgtgaggcagcctccatctactacaacatttgtgctgaatcaaataaatcatcttccacccttgggatctacaattgtaatgactaaaacaccacctgtaacaaccaacaggcaaaccatcactttaactaagtttatccagactactgcaagcacacgcccgtcagtctcagcaccaacagtacgaaatgccatgacctctgcaccttcaaaagaccaagttcagcttaaagatctactgaaaaataatagtcttaatgaactgatgaaactaaagccacctgctaatattgctcagccagtagcaacagcagctactgatgtaagcaatggtacagtaaagaaagagtcttctaataaagaaggagctagaatgtggataaacgacatgaagatgaggagtttttccccaaccatgaaggttcctgttgtaaaagaagatgatgaaccagaggaagaagatgaagaagaaatgggtcatgcagaaacctatgcagaatacatgccaataaaattaaaaattggcctacgtcatccagatgctgtagtggaaaccagctctttatccagtgttactcctcctgatgtttggtacaaaacatccatttctgaggaaaccattgataatggctggttatcagcattgcagcttgaggcaattacatatgcagcccagcaacatgaaactttcctacctaatggagatcgtgctggcttcttaataggtgatggtgccggtgtaggaaaaggaaggacgatagcaggaatcatctatgaaaattatttgttgagtagaaaacgagcattgtggtttagtgtttcaaatgacttaaagtatgatgctgaaagagatttaagggatattggagcaaaaaacattttggttcattcgttaaataagtttaaatacggaaaaatttcttccaaacataatgggagtgtgaaaaagggtgttatttttgctacttactcttcacttattggtgaaagccagtctggcggcaagtataaaactaggttaaaacaacttctgcattggtgcggtgatgacttcgatggagtgatagtgtttgatgagtgtcataaagccaaaaacttatgtcctgttggttcttcaaagccaaccaagacaggcttagcagttttagagcttcagaacaaattgccaaaagccagagttgtttatgctagtgcaactggtgcttctgaaccacgcaacatggcctatatgaaccgtcttggcatatggggtgagggtactccatttagagaattcagtgattttattcaagcagtagaacggagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctgtgggtcattgccagagagcggtttcagcaagctgcagatctgattgatgctgagcaacgaatgaagaagtccatgtggggtcagttctggtctgctcaccagaggttcttcaaatacttatgcatagcatccaaagttaaaagggttgtgcaactagctcgagaggaaatcaagaatggaaaatgtgttgtaattggtctgcagtctacaggagaagctagaacattagaagctttggaagagggcgggggagaattgaatgattttgtttcaactgccaaaggtgtgttgcagtcactcattgaaaaacattttcctgctccagacaggaaaaaactttatagtttactaggaatcgatttgacagctccaagtaacaacagttcgccaagagatagtccttgtaaagaaaataaaataaagaagcggaaaggtgaagaaataactcgagaagccaaaaaagcacgaaaagtaggtggccttactggtagcagttctgacgacagtggaagtgaatctgatgcctctgataatgaagaaagtgactatgagagctctaaaaacatgagttctggagatgatgacgatttcaacccatttttagatgagtctaatgaggatgatgaaaatgatccctggttaattaaaaaaaaaaaaaaaaaaaaaaaaaaaaaaaaaaaaaaaaaaaactcgag

SEQ ID NO: 153 - DNA, 2109 bp, Homo sapien
cagagagccccaggcatcgaggagaaggcggcggagaatggggccctggggtcccccgagagagaagagaaagtgctggagaatggggagctgacacccccaaggagggaggagaaagcgctggagaatggggagctgaggtccccagaggccggggagaaggtgctggtgaatgggggcctgacacccccaaagagcgaggacaaggtgtcagagaatgggggcctgagattccccaggaacacggagaggccaccagagactgggccttggagagccccagggccctgggagaagacgcccgagagttggggtccagcccccacgatcggggagccagccccagagacctctctggagagagcccctgcacccagcgcagtggtctcctcccggaacggcggggagacagcccctggcccccttggcccagcccccaagaacgggacgctggaacccgggaccgagaggagagcccccgagactgggggggcgccgagagccccaggggctgggaggctggacctcgggagtgggggccgagccccagtgggcacggggacggcccccggcggcggccccggaagcggcgtggacgcaaaggccggatgggtagacaacacgaggccgcagccaccgccgccaccgctgccaccgccaccggaggcacagccgaggaggctggagccagcgcccccgagagccaggccggaggtggcccccgagggagagcccggggccccagacagcagggccggcggagacacggcactcagcggagacggggacccccccaagcccgagaggaagggccccgagatgccacgactattcttggacttgggaccccctcaggggaacagcgagcagatcaaagccaggctctcccggctctcgctggcgctgccgccgctcacgctcacgccattcccggggccgggcccgcggcggcccccgtgggagggcgcggacgccggggcggctggcggggaggccggcggggcgggagcgccggggccggcggaggaggacggggaggacgaggacgaggacgaggaggaggacgaggaggcggcggcgccgggcgcggcggcggggccgcggggccccgggagggcgcgagcagccccggtgcccgtcgtggtgagcagcgccgacgcggacgcggcccgcccgctgcgggggctgctcaagtctccgcgcggggccgacgagccagaggacagcgagctggagaggaagcgcaagatggtctccttccacggggacgtgaccgtctacctcttcgaccaggagacgccaaccaacgagctgagcgtccaggccccccccgagggggacacggacccgtcaacgcctccagcgcccccgacacctccccaccccgccacccccggagatgggtttcccagcaacgacagcggctttggaggcagtttcgagtgggcggaggatttccccctcctcccccctccaggccccccgctgtgcttctcccgcttctccgtctcgcctgcgctggagaccccggggccacccgcccgggcccccgacgcccggcccgcaggccccgtggagaattgattccccgaagacccgaccccgctgcaccctcagaagaggggttgagaatggaatcctctgtggatgacggcgccactgccaccaccgcagacgccgcctctggggaggcccccgaggctgggccctccccctcccactcccctaccatgtgccaaacgggaggccccgggcccccgcccccccagccccccagatggctcccctgacccccctgaccccctcggagccaaatgaggcaggaatccccccgcccctccatagagagccgcctttctcggaactgaactgaactcttttgggcctggagcccctcgacacagcggaggtccctcctcacccactcctggcccaagacaggggccgcaggcttcggggacccggaccccccatttcgcgtctcccctttccctccccagcccggcccctggaggggcctctggttcaaaccttcgcgtggcattttcacattatttaaaaaagacaaaaacaactttttggaggaaaaaaaaaaaaaaaaaactcgag

SEQ ID NO: 154 - DNA, 1411 bp, Homo sapien
gaattcggcaccaggggagatgaggaagttcgatgttcctagcatggagtctacccttaaccagccagccatgctagagacgttatactcagatccacattaccgagcccatttccccaacccaagacctgatacaaataaggatgtatacaaagtattgccagaatccaagaaggcaccgggcagtggtgcagtatttgagaggaacggaccacatgctagcagtagtggggtgctccctttgggactccagcctgcgcctggactttccaagtcactatcctctcaggtgtggcaaccaagtcctgacccttggcatcctggagaacaatcctgtgaactcagtacttgtcgacagcagttggaattgatccgtttacagatggagcaaatgcagcttcagaacggagccatgtgtcaccatcctgctgctttcgctccattactgcccaccctagagccagcacagtggctcagcatcctgaacagtaacgagcatctcctgaaggagaaggagctcctcattgacaagcaaaggaagcatatctctcagctggagcagaaagtgcgagagagtgaactgcaagtccacagtgcccttttgggccgccctgccccctttggggatgtctgcttattgaggctacaggagttgcagcgagagaacactttcttacgggcacagtttgcacagaagacagaagccctgagcaaggagaagatggagcttgaaaagaaactctctgcatctgaagttgaaattcagctcattagggagtctctaaaagtgacactacagaagcattcggaggaggggaagaaacaggaggaaagggtcaaaggtcgtgataaacatatcaataatttgaaaaagaaatgtcagaaggaatcagagcagaaccgggagaagcagcagcgtattgaaaccttggagcgctatctagctgacctgcccaccctagaagaccatcagaaacagacggagcagcttaaggacgctgaattaaagaacacagaactgcaagagagagtggctgagctggagactttgctggaggacacccaggcaacctgcagagagaaggaggttcagctggaaagtctgagacaaagagaagcagacctctcctctgctagacataggtaatgccctgtgtacttgggggaaggagggagttcggttctggtgctctgttaactcttgtgtgttcaacagtgttcatttcaagttcctttcttctaagagctttgtgttctttgaattgaaagtcacttatggccgggtgtggtggcgcacacctttaatcccagcacttgggagtcagaggcaggctaatttctgagtttcaggacagccagggctatacagagaaaccctgtctcaaacaaaaaaaaaaaaaaaaaactcgag

SEQ ID NO: 155 - DNA, 678 bp, Homo sapien
ctggagtgaagggagctagtggtaaagggagctggtggaggggtggcggcaggggtaaggggcaggggacaccctctagacggagagcgggctccgaggtcctggctggccctcggtgcgcccgcccctgtgttggtcccacaatccctggcaatgagaggccagggtttattggacagagtcagttgtggggttcagagggtcagcaatcaatcaatcctccgaatccagagatttagacccagtcgtccgtattaggactggaggggggtcaataggttcagtgtttgagatgccaagggaacctgtcttttgatttggggttcaacatacagagttcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcacctacctcttttctcctgaagccttgaagcc

SEQ ID NO: 156 - DNA, 2668 bp, Homo sapien
gggaaggcggctgcgctgctgggcgggggcgggagctggagccggagctggagccggggccggggcccgggtcagcgcttgagccgggagaagagtttgagatcgtggaccgaagccagctgcccggcccaggcgacctgcggagcgcaacgaggccgcgggcggccgagggctggtcggcgcccatcctgaccctggcacgcagggccaccgggaacctgtcggcgagctgcgggagcgcgctgcgcgcggccgcggggctgggcggcggggacagcggggacggcacggcgcgcgcagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagtatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttcaaaaaaaaaaaaaaaaaaaaaaaaaaaaaaaaaaaaaaaaaaaaaaaaaaaaactcgag

SEQ ID NO: 157 - DNA, 2313 bp, Homo sapien
gaattcggcaccaggccgggcgggcgcctcagccatggccctgcgcaaggaactgctcaagtccatctggtacgcctttaccgcgctggacgtggagaagagtggcaaagtctccaagtcccagctcaaggtgctgtcccacaacctgtacacggtcctgcacatcccccatgaccccgtggccctggaggaacacttccgagatgatgatgacggccctgtgtccagccagggatacatgccctacctcaacaagtacatcctggacaaggtggaggagggggcttttgttaaagagcactttgatgagctgtgctggacgctgacggccaagaagaactatcgggcagatagcaacgggaacagtatgctctccaatcaggatgccttccgcctctggtgcctcttcaacttcctgtctgaggacaagtaccctctgatcatggttcctgatgaggtggaatacctgctgaaaaaggtactcagcagcatgagcttggaggtgagcttgggtgagctggaggagcttctggcccaggaggcccaggtggcccagaccaccggggggctcagcgtctggcagttcctggagctcttcaattcgggccgctgcctgcggggcgtgggccgggacaccctcagcatggccatccacgaggtctaccaggagctcatccaagatgtcctgaagcagggctacctgtggaagcgagggcacctgagaaggaactgggccgaacgctggttccagctgcagcccagctgcctctgctactttgggagtgaagagtgcaaagagaaaaggggcattatcccgctggatgcacactgctgcgtggaggtgctgccagaccgcgacggaaagcgctgcatgttctgtgtgaagacagccacccgcacgtatgagatgagcgcctcagacacgcgccagcgccaggagtggacagctgccatccagatggcgatccggctgcaggccgaggggaagacgtccctacacaaggacctgaagcagaaacggcgcgagcagcgggagcagcgggagcggcgccgggcggccaaggaagaggagctgctgcggctgcagcagctgcaggaggagaaggagcggaagctgcaggagctggagctgctgcaggaggcgcagcggcaggccgagcggctgctgcaggaggaggaggaacggcgccgcagccagcaccgcgagctgcagcaggcgctcgagggccaactgcgcgaggcggagcaggcccgggcctccatgcaggctgagatggagctgaaggaggaggaggctgcccggcagcggcagcgcatcaaggagctggaggagatgcagcagcggttgcaggaggccctgcaactagaggtgaaagctcggcgagatgaagaatctgtgcgaatcgctcagaccagactgctggaagaggaggaagagaagctgaagcagttgatgcagctgaaggaggagcaggagcgctacatcgaacgggcgcagcaggagaaggaagagctgcagcaggagatggcacagcagagccgctccctgcagcaggcccagcagcagctggaggaggtgcggcagaaccggcagagggctgacgaggatgtggaggctgcccagagaaaactgcgccaggccagcaccaacgtgaaacactggaatgtccagatgaaccggctgatgcatccaattgagcctggagataagcgtccggtcacaagcagctccttctcaggcttccagccccctctgcttgcccaccgtgactcctccctaaagcgcctgacccgctggggatcccagggcaacaggaccccctcgcccaacagcaatgagcagcagaagtccctcaatggtggggatgaggctcctgccccggcttccacccctcaggaagataaactggatccagcaccagaaaattagcctctcttagccccttgttcttcccaatgtcatatccaccaggacctggccacagctggcctgtgggtgatcccagctcttactaggagagggagctgaggtcctggtgccaggggcccaggccctccaaccataaacagtccaggatggaacctggttcacccttcataccagctccaagccccagaccatgggagctgtctgggatgttgatccttgagaacttggccctgtgctttagacccaaggacccgattcctgggctaggaaagagagaacaagcaagccggggctacctgcccccaggtggccaccaagttgtggaagcacatttctaaataaaaactgctcttagaatgaaaaaaaaaaaaaaaaaactcgag

SEQ ID NO: 158 - DNA, 2114 bp, Homo sapien
gaattcggcacgaggaagaactcgcctctgttgagtgtaagtagccaaacaataaccaaggagaataacagaaatgtccatttggagcactcagagcagaatcctggttcatcagcaggtgacacctcagcagcgcaccaggtggttttaggagaaaacttgatagccacagccctttgtctttctggcagtgggtctcagtctgatttgaaggatgtggccagcacagcaggagaggagggggacacaagccttcgggagagcctccatccagtcactcggtctcttaaggcagggtgccatactaagcagcttgcctccaggaattgctctgaagagaaatccccacaaacctccatcctaaaggaaggtaacagggacacaagcttggatttccgacctgtagtgtctccagcaaatggggttgaaggagtccgagtggatcaggatgatgatcaagatagctcttccctgaagctttctcagaacattgctgtacagactgactttaagacagctgattcagaggtaaacacagatcaagatattgaaaagaatttggataaaatgatgacagagagaaccctgttgaaagagcgttaccaggaggtcctggacaaacagaggcaagtggagaatcagctccaagtgcaattaaagcagcttcagcaaaggagagaagaggaaatgaagaatcaccaggagatattaaaggctattcaggatgtgacaataaagcgggaagaaacaaagaagaagatagagaaagagaagaaggagtttttgcagaaggagcaggatctgaaagctgaaattgagaagctttgtgagaagggcagaagagaggtgtgggaaatggaactggatagactcaagaatcaggatggcgaaataaataggaacattatggaagagactgaacgggcctggaaggcagagatcttatcactagagagccggaaagagttactggtactgaaactagaagaagcagaaaaagaggcagaattgcaccttacttacctcaagtcaactcccccaacactggagacagttcgttccaaacaggagtgggagacgagactgaatggagttcggataatgaaaaagaatgttcgtgaccaatttaatagtcatatccagttagtgaggaacggagccaagctgagcagccttcctcaaatccctactcccactttacctccacccccatcagagacagacttcatgcttcaggtgtttcaacccagtccctctctggctcctcggatgcccttctccattgggcaggtcacaatgcccatggttatgcccagtgcagatccccgctccttgtctttcccaatcctgaaccctgccctttcccagcccagccagccttcctcaccccttcctggctcccatggcagaaatagccctggcttgggttcccttgtcagccctggtgccgaattcggcacgaggtaccactggtctgtgtgctagaggagggtgttgccatagaaccagtggccacagttgtggtggtggtggtcagcactgtgggggtgtgggtggtccccgggacggaggagggggtcaccgtgaagccactggttgtgggtgtggtggttgtgctgatccacactggaggcgtgcgtgccgtccctgggctgaaggagggggtgactgtgaagcccgtggttgtggtagtcggcactttggtagtgtgagctgttcctggggtggaagagggggtggccacagagccggtggccctggttgtggtggccgtggtggtaagcactgtggaggtgtgggcagtctctggagtggaggagggtgtggctgtggacatggtggccgtgggtgtggtggtctgtgataggcgggtccaggtggtgcccagggaggaggaggggatggctgtaaagctggtagctgtgggtgtggtggctgtgcttctcagtgctggaagggcggttgcagtccctggactggagaagggagtggctttggagctggtgactgtgggtgtcgtggccgtggtgctcacatgtggggtgccagcagttgcctgggtggaggaggcggtggccgtggatccggtgggcaccgtcacgggagtacttcta

SEQ ID NO: 159 - DNA, 278 bp, Homo sapien
gaattcggcacaggtaactttgcctggggtatttaaaaaaaaaaaaaaaaaaaaaaaaagtcaaatatctgagtactaatttcctgaaaagtatgttccgatagatgaacagatcattaatgcagaatgagaatcactcctaaaataggtaatggtaaaaattaaattgacaattacctctctctatgcagaaggaaatatcacctatatgacatcatcatcatctattgatacttgctggcagtgctaataatggttttaatgccaatttgtaagaa

SEQ ID NO: 160 - DNA, 848 bp, Homo sapien
gaattcggcacgagccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaaaaaaaaaaaaaaaaaaaaaactcgag

SEQ ID NO: 161 - DNA, 432 bp, Homo sapien
gaattcggcacgagggcagaccaagatcctggaggaggacctggaacagatcaagctgtccttgagagagcgaggccgggagctgaccactcagaggcagctgatgcaggaacgggcagaggaagggaagggcccaagtaaagcacagcgcgggagcctagagcacatgaagctgatcctgcgtgataaggagaaggaggtggaatgtcagcaggagcatatccatgaactccaggagctcaaagaccagctggagcagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagag

SEQ ID NO: 162 - DNA, 433 bp, Homo sapien
gattcggcacgagccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaactcgcaaactttgagaagaacgtgagccaagctatccacaagtacaatgcttacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagattcggcaggatgatacgagttcatccatcaatttcctgactcgag

SEQ ID NO: 163 - DNA, 432 bp, Homo sapien
gaattcggcaccagatgaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagtccgacaaagcggctctccagcaagaaggtggcaaggtacctgcaccagtc

SEQ ID NO: 164 - DNA, 395 bp, Homo sapien
gacacttgaatcatgggtgacgttaaaaattttctgtatgcctggtgtggcaaaaggaagatgaccccatcctatgaaattagagcagtggggaacaaaaacaggcagaaattcatgtgtgaggttcaggtggaaggttataattacactggcatgggaaattccaccaataaaaaagatgcacaaagcaatgctgccagagactttgttaactatttggttcgaataaatgaaataaagagtgaagaagttccagcttttggggtagcatctccgcccccacttactgatactcctgacactacagcaaatgctgaaggcatcttgttgacatcgaatatgactttgataataaataccggttcctgaaaaaaaaaaaaaaaaaaaaactcgag

SEQ ID NO: 165 - DNA, 503 bp, Homo sapien
gaattcggcaccaggaacgctcggtgagaggcggaggagcggtaactaccccggttgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggccttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggct

SEQ ID NO: 166 - DNA, 893 bp, Homo sapien
gaattcggcacgagaggaacttctcttgacgagaagagagaccaaggaggccaagcaggggctgggccagaggtgccaacatggggaaactgaggctcggctcggaagggtgagagtgagactacatctcaaaaaaaaaaaaaaaaaaaaaaaagaaagaaaagaaaagaaaaaagaaagaacggaagtagttgtaggtagtggtatggtggtatgagtctgttttctgttacttataacaacaacaacaacaaaaaacgctgaaactgggtaatttataaagaaaaggaaaaaaagcagaaaaaaatcaggaagaagagaaaggaaaagaagacaaataaatgaaatttatgtattacagttctgaaggctgagacatcccaggtcaagggtccacacttggcgagggctttcttgctggtggagactctttgtggagtcctgggacagtgcagaaggatcacgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaaaaaaaactcgag

SEQ ID NO: 167 - DNA, 549 bp, Homo sapien
gaattcggcacgagcccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaagagtttaaggagctgaaagcgcgcaatac

SEQ ID NO: 168 - DNA, 547 bp, Homo sapien
gaattcggcacgagatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaaggggatgtgctgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggctggaagacttggaagcacagtatttgtagcaaatctggattataaagttggctg

SEQ ID NO: 169 - DNA, 547 bp, Homo sapien
gaattcggcaccaggagtccgactgtgctcgctgctcagcgccgcacccggaagatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctc

SEQ ID NO: 170 - DNA, 838 bp, Homo sapien
gaattcggcaccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgatggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaaaaaaaaaaaaaaaaaactcgag

SEQ ID NO: 171 - DNA, 547 bp, Homo sapien
gaattcggcaccagcgggatttgggtcgcagttcttgtttgtggattgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctg

SEQ ID NO: 172 - DNA, 608 bp, Homo sapien
gaattcggcaccagagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtc

SEQ ID NO: 173 - DNA, 543 bp, Homo sapien
gaattcggcaccagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggaacggctgactgtggatgaagctgtgcggaagggcctcgtggggcccgaactgcacgaccgcctgctctcggctgagcgggcggtcaccggctaccgtgacccctacaccgagcagaccatctcgctcttccaggccatgaagaaggaactgatccctactgaggaggccctgcggctgtggatgcccagctggccacc

SEQ ID NO: 174 - DNA, 548 bp, Homo sapien
gaattcggcacgagaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaaggggatgtgctgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggtgatggctacgactggtgggatgggtatgggaccaggtggcccaggaatgatta

SEQ ID NO: 175 - DNA, 604 bp, Homo sapien
gaattcggcaccagaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagcttatccaggaggccctcatcttcgacaacaagcacaccaactataccatggagcacatccgcgtgggctgggagcagctgctcaccaccattgcccgg

SEQ ID NO: 176 - DNA, 486 bp, Homo sapien
gaattcggcaccagccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaaggc

SEQ ID NO: 177 - DNA, 387 bp, Homo sapien
gaattcggcaccagggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcc

SEQ ID NO: 178 - DNA, 440 bp, Homo sapien
gaattcggcacgaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctctagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggt

SEQ ID NO: 179 - DNA, 443 bp, Homo sapien
gaattcggcaccagcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctgg

SEQ ID NO: 180 - DNA, 403 bp, Homo sapien
gaattcggcacgaggttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcagatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagc

SEQ ID NO: 181 - DNA, 493 bp, Homo sapien
gaattcggcaccagcagaggtctccagagccttctctctcctgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgaccgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacc

SEQ ID NO: 182 - protein, 209 aa, Homo sapien
AFSSNPKVQVEAIEGGALQKLLVILATEQPLTAKKKVLFALCSLLRHFPYAQRQFLKLGGLQVLRTLVQEKGTEVLAVRVVTLLYDLVTEKMFAEEEAELTQEMSPEKLQQYRQVHLLPGLWEQGWCEITAHLLALPEHDAREKVLQTLGVLLTTCRDRYRQDPQLGRTLASLQAEYQVLASLELQDGEDEGYFQELLGSVNSLLKELR

SEQ ID NO: 183 - protein, 255 aa, Homo sapien
MAAGVEAAAEVAATEPKMEEESGAPCVPSGNGAPGPKGEERPTQNEKRKEKNIKRGGNRFEPYSNPTKRYRAFITNIPFDVKWQSLKDLVKEKVGEVTYVELLMDAEGKSRGCAVVEFKMEESMKKAAEVLNKHSLSGRPLKVKEDPDGEHARRAMQKAGRLGSTVFVANLDYKVGWKKLKEVFSMAGVVVRADILEDKDGKSRGIGIVTFEQSIEAVQAISMFNGQLLFDRPMHVKMDERALPKGDFFPPERHS

SEQ ID NO: 184 - protein, 188 aa, Homo sapien
LSGSCIRREQTPEKEKQVVLFEEASWTCTPACGDEPRTVILLSSMLADHRLKLEDYKDRLKSGEHLNPDQLEAVEKYEEVLHNLEFAKELQKTFSGLSLDLLKAQKKAQRREHMLKLEAEKKKLRTILQVQYVLQNLTQEHVQKDFKGGLNGAVYLPSKELDYLIKFSKLTCPERNESLRQTLEGSTV

SEQ ID NO: 185 - protein, 746 aa, Homo sapien
DKHLKDLLSKLLNSGYFESIPVPKNAKEKEVPLEEEMLIQSEKKTQLSKTESVKESESLMEFAQPEIQPQEFLNRRYMTEVDYSNKQGEEQPWEADYARKPNLPKRWDMLTEPDGQEKKQESFKSWEASGKHQEVSKPAVSLEQRKQDTSKLRSTLPEEQKKQEISKSKPSPSQWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVPKPVHQPVGSSSTLPKDPVLRKEKLQDLMTQIQGTCNFMQESVLDFDKPSSAIPTSQPPSATPGSPVASKEQNLSSQSDFLQEPLQVFNVNAPLPPRKEQEIKESPYSPGYNQSFTTASTQTPPQCQLPSIHVEQTVHSQETAANYHPDGTIQVSNGSLAFYPAQTNVFPRPTQPFVNSRGSVRGCTRGGRLITNSYRSPGGYKGFDTYRGLPSISNGNYSQLQFQAREYSGAPYSQRDNFQQCYKRGGTSGGPRANSRAGWSDSSQVSSPERDNETFNSGDSGQGDSRSMTPVDVPVTNPAATILPVHVYPLPQQMRVAFSAARTSNLAPGTLDQPIVFDLLLNNLGETFDLQLGRFNCPVNGTYVFIFHMLKLAVNVPLYVNLMKNEEVLVSAYANDGAPDHETASNHAILQLFQGDQIWLRLHRGAIYGSSWKYSTFSGYLLYQD

SEQ ID NO: 186 - protein, 705 aa, Homo sapien
ALLNVRQPPSTTTFVLNQINHLPPLGSTIVMTKTPPVTTNRQTITLTKFIQTTASTRPSVSAPTVRNAMTSAPSKDQVQLKDLLKNNSLNELMKLKPPANIAQPVATAATDVSNGTVKKESSNKEGARMWINDMKMRSFSPTMKVPVVKEDDEPEEEDEEEMGHAETYAEYMPIKLKIGLRHPDAVVETSSLSSVTPPDVWYKTSISEETIDNGWLSALQLEAITYAAQQHETFLPNGDRAGFLIGDGAGVGKGRTIAGIIYENYLLSRKRALWFSVSNDLKYDAERDLRDIGAKNILVHSLNKFKYGKISSKHNGSVKKGVIFATYSSLIGESQSGGKYKTRLKQLLHWCGDDFDGVIVFDECHKAKNLCPVGSSKPTKTGLAVLELQNKLPKARVVYASATGASEPRNMAYMNRLGIWGEGTPFREFSDFIQAVERRGVGAMEIVAMDMKLRGMYIARQLSFTGVTFKIEEVLLSQSYVKMYNKAVKLWVIARERFQQAADLIDAEQRMKKSMWGQFWSAHQRFFKYLCIASKVKRVVQLAREEIKNGKCVVIGLQSTGEARTLEALEEGGGELNDFVSTAKGVLQSLIEKHFPAPDRKKLYSLLGIDLTAPSNNSSPRDSPCKENKIKKRKGEEITREAKKARKVGGLTGSSSDDSGSESDASDNEESDYESSKNMSSGDDDDFNPFLDESNEDDENDPWLI

SEQ ID NO: 187 - protein, 595 aa, Homo sapien
ESPRHRGEGGGEWGPGVPRERRESAGEWGADTPKEGGESAGEWGAEVPRGRGEGAGEWGPDTPKERGQGVREWGPEIPQEHGEATRDWALESPRALGEDARELGSSPHDRGASPRDLSGESPCTQRSGLLPERRGDSPWPPWPSPQERDAGTRDREESPRDWGGAESPRGWEAGPREWGPSPSGHGDGPRRRPRKRRGRKGRMGRQHEAAATAATAATATGGTAEEAGASAPESQAGGGPRGRARGPRQQGRRRHGTQRRRGPPQAREEGPRDATTILGLGTPSGEQRADQSQALPALAGAAAAHAHAIPGAGPAAAPVGGRGRRGGWRGGRRGGSAGAGGGGRGGRGRGRGGGRGGGGAGRGGGAAGPREGASSPGARRGEQRRRGRGPPAAGAAQVSARGRRARGQRAGEEAQDGLLPRGRDRLPLRPGDANQRAERPGPPRGGHGPVNASSAPDTSPPRHPRRWVSQQRQRLWRQFRVGGGFPPPPPSRPPAVLLPLLRLACAGDPGATRPGPRRPARRPRGELIPRRPDPAAPSEEGLRMESSVDDGATATTADAASGEAPEAGPSPSHSPTMCQTGGPGPPPPQPPRWLP

SEQ ID NO: 188 - protein, 376 aa, Homo sapien
EMRKFDVPSMESTLNQPAMLETLYSDPHYRAHFPNPRPDTNKDVYKVLPESKKAPGSGAVFERNGPHASSSGVLPLGLQPAPGLSKSLSSQVWQPSPDPWHPGEQSCELSTCRQQLELIRLQMEQMQLQNGAMCHHPAAFAPLLPTLEPAQWLSILNSNEHLLKEKELLIDKQRKHISQLEQKVRESELQVHSALLGRPAPFGDVCLLRLQELQRENTFLRAQFAQKTEALSKEKMELEKKLSASEVEIQLIRESLKVTLQKHSEEGKKQEERVKGRDKHINNLKKKCQKESEQNREKQQRIETLERYLADLPTLEDHQKQTEQLKDAELKNTELQERVAELETLLEDTQATCREKEVQLESLRQREADLSSARHR

SEQ ID NO: 189 - protein, 160 aa, Homo sapien
MLEAHRRQRHPFLLLGTTANRTQSLNYGCIVENPQTHEVLHYVEKPSTFISDIINCGIYLFSPEALKPLRDVFQRNQQDGQLEDSPGLWPGAGTIRLEQDVFSALAGQGQIYVHLTDGIWSQIKSAGSALYASRLYLSRYQDTHPERLAKHTPGGPWIRG

SEQ ID NO: 190 - protein, 146 aa, Homo sapien [sequence omitted]

SEQ ID NO: 191 - protein, 704 aa, Homo sapien
EGGCAAGRGRELEPELEPGPGPGSALEPGEEFEIVDRSQLPGPGDLRSATRPRAAEGWSAPILTLARRATGNLSASCGSALRAAAGLGGGDSGDGTARAASKCQMMEERANLMHMMKLSIKVLLQSALSLGRSLDADHAPLQQFFVVMEHCLKHGLKVKKSFIGQNKSFFGPLELVEKLCPEASDIATSVRNLPELKTAVGRGRAWLYLALMQKKLADYLKVLIDNKHLLSEFYEPEALMMEEEGMVIVGLLVGLNVLDANLCLKGEDLDSQVGVIDFSLYLKDVQDLDGGKEHERITDVLDQKNYVEELNRHLSCTVGDLQTKIDGLEKTNSKLQEELSAATDRICSLQEEQQQLREQNELIRERSEKSVEITKQDTKVELETYKQTRQGLDEMYSDVWKQLKEEKKVRLELEKELELQIGMKTEMEIAMKLLEKDTHEKQDTLVALRQQLEEVKAINLQMFHKAQNAESSLQQKNEAITSFEGKTNQVMSSMKQMEERLQHSERARQGAEERSHKLQQELGGRIGALQLQLSQLHEQCSSLEKELKSEKEQRQALQRELQHEKDTSSLLRMELQQVEGLKKELRELQDEKAELQKICEEQEQALQEMGLHLSQSKLKMEDIKEVNQALKGHAWLKDDEATHCRQCEKEFSISRRKHHCRNCGHIFCNTCSSNELALPSYPKPVRVCDSCHTLLLQRCSSTAS

SEQ ID NO: 192 - protein, 331 aa, Homo sapien
RAGASAMALRKELLKSIWYAFTALDVEKSGKVSKSQLKVLSHNLYTVLHIPHDPVALEEHFRDDDDGPVSSQGYMPYLNKYILDKVEEGAFVKEHFDELCWTLTAKKNYRADSNGNSMLSNQDAFRLWCLFNFLSEDKYPLIMVPDEVEYLLKKVLSSMSLEVSLGELEELLAQEAQVAQTTGGLSVWQFLELFNSGRCLRGVGRDTLSMAIHEVYQELIQDVLKQGYLWKRGHLRRNWAERWFQLQPSCLCYFGSEECKEKRGIIPLDAHCCVEVLPDRDGKRCMFCVKTATRTYEMSASDTRQRQEWTAAIQMAIRLQAEGKTSLHKDL

SEQ ID NO: 193 - protein, 475 aa, Homo sapien
KNSPLLSVSSQTITKENNRNVHLEHSEQNPGSSAGDTSAAHQVVLGENLIATALCLSGSGSQSDLKDVASTAGEEGDTSLRESLHPVTRSLKAGCHTKQLASRNCSEEKSPQTSILKEGNRDTSLDFRPVVSPANGVEGVRVDQDDDQDSSSLKLSQNIAVQTDFKTADSEVNTDQDIEKNLDKMMTERTLLKERYQEVLDKQRQVENQLQVQLKQLQQRREEEMKNHQEILKAIQDVTIKREETKKKIEKEKKEFLQKEQDLKAEIEKLCEKGRREVWEMELDRLKNQDGEINRNIMEETERAWKAEILSLESRKELLVLKLEEAEKEAELHLTYLKSTPPTLETVRSKQEWETRLNGVRIMKKNVRDQFNSHIQLVRNGAKLSSLPQIPTPTLPPPPSETDFMLQVFQPSPSLAPRMPFSIGQVTMPMVMPSADPRSLSFPILNPALSQPSQPSSPLPGSHGRNSPGLGSLVS

SEQ ID NO: 194 - protein, 241 aa, Homo sapien
MSGESARSLGKGSAPPGPVPEGSIRIYSMRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSQNKEDYAGLKEEFRKEFTKLEEVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 195 - protein, 138 aa, Homo sapien
QTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQ

SEQ ID NO: 196 - protein, 102 aa, Homo sapien
MSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTR

SEQ ID NO: 197 - protein, 138 aa, Homo sapien
EANEVTDSAYMGSESTYSECETFTDEDTSTLVHPELQPEGDADSAGGSAVPSECLDAMEEPDHGALLLLPGRPHPHGQSVITVIGGEEHFEDYGEGSEAELSPETLCNGQLGCSDPAFLTPSPTKRLSSKKVARYLHQ

SEQ ID NO: 198 - protein, 100 aa, Homo sapien
MGDVKNFLYAWCGKRKMTPSYEIRAVGNKNRQKFMCEVQVEGYNYTGMGNSTNKKDAQSNAARDFVNYLVRINEIKSEEVPAFGVASPPPLTDTPDTTAN

SEQ ID NO: 199 - protein, 127 aa, Homo sapien
MVKETTYYDVLGVKPNATQEELKKAYRKLALKYHPDKNPNEGEKFKQISQAYEVLSDAKKRELYDKGGEQAIKEGGAGGGFGSPMDIFDMFFGGGGRMQRERRGKNVVHQLSVTLEDLYNGATRKLA

SEQ ID NO: 200 - protein, 90 aa, Homo sapien
MACPLDQAIGLLVAIFHKYSGREGDKHTLSKKELKELIQKELTIGSKLQDAEIARLMEDLDRNKDQEVNFQEYVTFLGALALIYNEALKG

SEQ ID NO: 201 - protein, 120 aa, Homo sapien
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARN

SEQ ID NO: 202 - protein, 177 aa, Homo sapien
MAAGVEAAAEVAATEIKMEEESGAPGVPSGNGAPGPKGEGERPAQNEKRKEKNIKRGGNRFEPYANPTKRYRAFITNIPFDVKWQSLKDLVKEKVGEVTYVELLMDAEGKSRGCAVVEFKMEESMKKAAEVLNKHSLSGRPLKVKEDPDGEHARRAMQKAGRLGSTVFVANLDYKVG

SEQ ID NO: 203 - protein, 164 aa, Homo sapien
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKP

SEQ ID NO: 204 - protein, 241 aa, Homo sapien [sequence omitted]

SEQ ID NO: 205 - protein, 160 aa, Homo sapien
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTL

SEQ ID NO: 206 - protein, 197 aa, Homo sapien
TSPSEACAPLLISLSTLIYNGALPCQCNPQGSLSSECNPHGGQCLCKPGVVGRRCDLCAPGYYGFGPTGCQGACLGCRDHTGGEHCERCIAGFHGDPRLPYGGQCRPCPCPEGPGSQRHFATSCHQDEYSQQIVCHCRAGYTGLRCEACAPGHFGDPSRPGGRCQLCECSGNIDPMDPDACDPHTGQCLRCLHHTEG

SEQ ID NO: 207 - protein, 175 aa, Homo sapien
IIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLWMPSWP

SEQ ID NO: 208 - protein, 177 aa, Homo sapien
MAAGVEAAAEVAATEIKMEEESGAPGVPSGNGAPGPKGEGERPAQNEKRKEKNIKRGGNRFEPYANPTKRYRAFITNIPFDVKWQSLKDLVKEKVGEVTYVELLMDAEGKSRGCAVVEFKMEESMKKAAEVLNKHSLSGRPLKVKEDPDGEHARRAMQKVMATTGGMGMGPGGPGMI

SEQ ID NO: 209 - protein, 196 aa, Homo sapien
DLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIAR

SEQ ID NO: 210 - protein, 156 aa, Homo sapien
KLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPK

SEQ ID NO: 211 - protein, 92 aa, Homo sapien
MESPSAPPHRWCIPWQRLLLTASLLTFWNPPTTAKLTIESTPFNVAEGKEVLLLVHNLPQHLFGYSWYKGERVDGNRQIIGYVIGTQQATPG

SEQ ID NO: 212 - protein, 142 aa, Homo sapien
EKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQG

SEQ ID NO: 213 - protein, 142 aa, Homo sapien
GGYGGGYGGVLTASDGLLAGNEKLTMQNLNDRLASYLDKVRALEAANGELEVKIRDWYQKQGPGPSRDYSHYYTTIQDLRDKILGATIENSRIVLQIDNARLAADDFRTKFETEQALRMSVEADINGLRRVLDELTLARTDL

SEQ ID NO: 214 - protein, 129 aa, Homo sapien
VMRVDFNVPMKNNQITNNQRIKAAVPSIKFCLDNGAKSVVLMSHLGRPDGVPMPDKYSLEPVAVELRSLLGKDVLFLKDCVGPEVEKACANPAAGSVILLENLRFHVEEEGKGKDASGNKVKAEPAKIE

SEQ ID NO: 215 - protein, 148 aa, Homo sapien
MATLKEKLIAPVAEEEATVPNNKITVVGVGQVGMACAISILGKSLADELALVDVLEDKLKGEMMDLQHGSLFLQTPKIVADKDYSVTANSKIVVVTAGVRQQEGESRLNLVQRNVNVFKFIIPQIVKYSPDCIIIVVSNPVDILTYVT

SEQ ID NO: 216 - protein, 527 aa, Homo sapien
QRAPGIEEKAAENGALGSPEREEKVLENGELTPPRREEKALENGELRSPEAGEKVLVNGGLTPPKSEDKVSENGGLRFPRNTERPPETGPWRAPGPWEKTPESWGPAPTIGEPAPETSLERAPAPSAVVSSRNGGETAPGPLGPAPKNGTLEPGTERRAPETGGAPRAPGAGRLDLGSGGRAPVGTGTAPGGGPGSGVDAKAGWVDNTRPQPPPPPLPPPPEAQPRRLEPAPPRARPEVAPEGEPGAPDSRAGGDTALSGDGDPPKPERKGPEMPRLFLDLGPPQGNSEQIKARLSRLSLALPPLTLTPFPGPGPRRPPWEGADAGAAGGEAGGAGAPGPAEEDGEDEDEDEEEDEEAAAPGAAAGPRGPGRARAAPVPVVVSSADADAARPLRGLLKSPRGADEPEDSELERKRKMVSFHGDVTVYLFDQETPTNELSVQAPPEGDTDPSTPPAPPTPPHPATPGDGFPSNDSGFGGSFEWAEDFPLLPPPGPPLCFSRFSVSPALETPGPPARAPDARPAGPVEN

SEQ ID NO: 217 - DNA, 466 bp, Homo sapien
gaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcga

SEQ ID NO: 218 - DNA, 381 bp, Homo sapien
gagtttccttcgcaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctatcttgta

SEQ ID NO: 219 - DNA, 1293 bp, Homo sapien
gaggggaggcgcatggcggggatggcgctggcgcgggcctggaagcagatgtcctggttctactaccagtacctgctggtcacggcgctctacatgctggagccctgggagcggacggtgttcaattccatgctggtttccattgtggggatggcactatacacaggatacgtcttcatgccccagcacatcatggcgatattgcactactttgaaatcgtacaatgaccaagatgcgaccaggatcagaggttccttggggaagacccaccctacgaagttggaatgagaccatcagatgtgataagaaactcttctagatgtcaacataaccaaccttataaagactaaaattcatgagtagaacaggaaaatcatcctgactcatgtgttgtgttctttatttttaattttcaaagaggctcttgtatagcagtttttgtctattttaacattgtagtcatttgtactttgatatcagtattttcttaacctttgtgactgtttcaatattacccccgtgaaagcttttcttaatgtaactttgagtacattttaattgccttctatttttaaaactcaaaatcattagttgggctttactgttcttgctattgtatggcatatacatctgcctggatatatttctactcttgaccaaagttttgtaaagaacaatataagatttcgggtaggggtatggggagggaagatattttattgagaactacttaacaaaagatttatctgtaagcttgaactcaggagtacagttttagctatctagactctaacagcttttgctttaaaattattaaagtgtttcttaatgaaaaagaaaagatcttgctaaagttaaaataaggaacatttcaccttttaaatatttaattcttatgtggacttatttccagaaaactttggtgataattcttgagacaaaaggtggttaagtagcattattatgtaatgcttatataccatagagtttttaatagaagagaaatccatttcctccgagggtcactattaacaatgtacttccttaaatttagtttaatgattgtaatgggtgctgcatttgcacattgcattaagttatgatgagacgaattgttgttaaaaattatagcaaaaagaaatgtaaacttggttaaaatcctttcactctttgtattgttttttttaaggtttttattccttaaatgtaaaatgactacctaattttttgatgtaaatacattaaattcaaagagaaaaaaaatcaaaaaaaaaaaaaaaaaaaaactcgag

SEQ ID NO: 220 - DNA, 983 bp, Homo sapien
caggttattctgatcctgccgcctgtcttccctgtaagagtggagcctcgaggtgtaccttaaagtgaccggaatgttagagatgcaatttgcagagctggggcaaggaagggctccttgtcactgtagttactttccttgcagtggccaaatgcccaataagaaggaatacatgaccactgctgtggggagtcagcaggtgcgtgatgcagctggccacactccatccacggccatgacataaaacagacaagaagtaaggctggactgtaacacctcaaggcctgctccagtgacccactttcttcagagaggctctaccacacacacaaccaccttccaaatttacactcagatcactacaccatgtctcccaagttaaaacatgtatccacctagactttaaatgtgctttgtaactgttgatggcactgtacagagggccaaagtatttcccatcagatagcatttttctgaacccatgcctcttgggacgagatcacaggacttgacccatcatcaaataggaccaggtgacctacagagacatcacaatgatggcttcctacagtcaagtccatttccaataatgctctcatctaagagaacccatgaaccttatttgaatcctggttcaaacaaaaaccttaaattatttatgagacaattataaacttgatagattttgatgtgtgaaggtatttatgaatatttttagtcagtgatggtatactgttaaggaaaaggttcatattttagggacaaaggctgaaacatttatggacagagtgatatgatatctgggatttgttttaggatgaagtgggagggaggaaatgaatggaaatagtgttgaaacagtattggccacgagtcagctattgtgtgctaagacgctcctcacaccagtctactctgtatgtgtttgaatatctctgtaataaacttaacaaggaaaaaaaaaaaaaaaaaaaaaactcgag

SEQ ID NO: 221 - DNA, 373 bp, Homo sapien
cattttatgggttaattttttattaaatagcaataagatacttttataactcaataaaattattcaatgatacattcggaaaataaatgtataaaatatgaaaaagtactaaaaagcatttttcagtacttttaggtaagattaatccaactaaacactagcatatgttatacagtaataataaggggaaaatacaataatgttgagaaagcaaactcaaagcatagatcaatgaaaaaattgagaaatggacataaatgatttagtatttttaaagagagtgaaaaatcattattttatgcttttgtgtagcgttagatgaattaaataacatatgcacatatagctttgcgatacaaatttccagaccata

SEQ ID NO: 222 - DNA, 544 bp, Homo sapien
cagagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagctagatttacagagtaaatttgtggccaaagaa

SEQ ID NO: 223 - DNA, 316 bp, Homo sapien
gaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttctacaccaataaatgaaggacagactgtgttagacaaggtggctgagcagtgtgaacctgctgaaagtcagccagaagcacttctgagaggaagatgtttgcaaggtaactctaacagttg

SEQ ID NO: 224 - DNA, 1583 bp, Homo sapien
cagaccacgtctgccctcgccgctctagccctgcgccccagcccggccgcggcacctccgcctcgccgccgctaggtcggccggctccgcccggctgccgcctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttttgccaataaagttgcatggtaaatatttcattacagaatttatgttagagctttcatgccaagaatgttttcttacaaaattctctttttattgaggtttcactaataagcagcttctacttttgagcctcaacttaaagcagaactgttttttactggatttttcattaacagcaagcttttttttttatgtaaaataaatctattgtgaattgaaaaaaaaaaaaaaaaaaaaaactcgag

SEQ ID NO: 225 - DNA, 491 bp, Homo sapien
gaacaacatcatcttgaatcactagatagactcttgacggaaagcaaaggggaaatgaaaaaggaaaatatgaagaaagatgaagctttaaaagcattacagaaccaagtatctgaagaaacaatcaaggttaggcaactagattcagcattggaaatttgtaaggaagaacttgtcttgcatttgaatcaattggaaggaaataaggaaaagtttgaaaaacagttaaagaagaaatctgaagaggtatattgtttacagaaagagctaaagataaaaaatcacagtcttcaagagacttctgagcaaaacgttattctacagcatactcttcagcaacagcagcaaatgttacaacaagagacaattagaaatggagagctagaagatactcaaactaaacttgaaaaacaggtgtcaaaactggaacaagaacttcaaaaacaaagggaaagttcagctgaaaagttgagaaaaatggaggagaaatg

SEQ ID NO: 226 - DNA, 483 bp, Homo sapien
cagccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagaaagatgtagatgtccgtaggagaattgaacttattcaggactttgaaatgcctactgtgtgtaccactattaaggtgtcaaaagatggacagtacattttagcaactggaacatataaacctcgggttcgatgttatgacacctatcaattatccttgaagtttgaaaggtgtttagattcagaagttgtcacctttgaaattttgtctgatgactactcaaagattgtcttcttacataatgatagatacattgaatttcattcgcaatcaggtttt

SEQ ID NO: 227 - DNA, 486 bp, Homo sapien
gagcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacagtgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcg

SEQ ID NO: 228 - DNA, 494 bp, Homo sapien
gaggccaggactccgggaatgcgagcaggccccttattctcccagtggcctcggtctgtccccacagcggcccggtcagggttgcccgagccccaaggcggggggcggcaccggggtgctgaaagggacagaatgctttgacctccaagctgttttaaatctagtagataagccagatcctgtgttgccataagcccttggcccacatttaagtgggaatgcagctagcttggatgtctgaaactttgtaagcgccttctgtctgaatcctgaacacaggcaccaagactactgaagaagctcgtcattcttgtgcagggatagccacacaagcaaacatgtttgcaaaacttgaaagaaagaaaattgcagaaagaagacttgctgttcttaagaggcccaggaaggtgctacttaggaatcccaccggcttgtgaagcaagggaatcaagtttgccttcaatggggaacttgacttcaggaaaatgaacttt

SEQ ID NO: 229 - DNA, 465 bp, Homo sapien
gtcagagagctggtataacctcctgttggacatgcagaaccgactcaataaggtcatcaaaagcgtgggcaagattgagcactccttctggagatcctttcacactgagcgaaagacagaaccagccacaggcttcatcgatggtgatctgattgaaagtttcctagatatcagccgccctaagatgcaggaggttgtggcaaacttgcagtatgatgatggcagtggtatgaagcgggaggcaactgcagatgacctcatcaaagtcgtggaggaactaactcggatccattagccaaggacaggatctcttttcctgaccctcctaaaggcgttgccctcctatcctcccttccttgcccacccttggtttctttggcatgggaaggttttccttaaccacttgccctagagccaccagtgaccttgtgtggaaacagggttttttttacttaaaacagttca

SEQ ID NO: 230 - DNA, 495 bp, Homo sapien
caggggaaagggtgtttggccttgaccagccactgctgacctcaatctcagacctacagatggtgaatatctccctgcgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtatccctgttgatccgccgggagctgacagaaagggccaaaggacttcagcctcatcctggatgatgtggccatcacagacttgagctttagccgagaagtacacaagctgcctgtaagaaacccaaccaagtggggtgaattccaaaaacccgtgggggtgaagggcttcttaagaatgcaaggaaggaggaaaagaattccatggggggggggttccttaacccaggaacaggggtttcccttgaatttttttcca

SEQ ID NO: 231 - DNA, 498 bp, Homo sapien
ggcagcttctgagaccagggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctgcctcctacctggacaaagtgcgcgccctggaagcgggcaacggcgaacttagaggtgaaagaatcccgcgaactggtaccaaaaacaaggggcctggggccttccgcgacttacagccaacttactacaccgaacattcaagaacttgcgggaacaaaaatttttggtgccacccattt

SEQ ID NO: 232 - DNA, 465 bp, Homo sapien
caggccggccgagtaggaaagctggaggcgcgggtggggaacatgtctgagtcggagctcggcaggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaaatcatgtttattcctcaggaatacttgaagtgccctggagtaaactgccattcttctgtaacaatggtatcagtaatgctttaaactccagcacctggttatgcatttgaaacccaagtctggttcttggtttggattttctctctgg

SEQ ID NO: 233 - DNA, 366 bp, Homo sapien
  misc_feature (1)...(366): n = A,T,C or G
cagtaaaaaaggttatgttttattaattgctggacaaccgtgggaaaacaaataagcaattgacaccaccaaattcttattacattcaanataaaanatttattcacaccacaaaaagataatcacaacaaaatatacactaacttaaaaaacaaaagattatagtgacataaaatgttatattctctttttaagtgggtaaaagtattttgtttgcttctacataaatttctattcatgananaataacaaatattaaaatacagtgatagtttgcatttcttctatagaatgaacatagacataaccctgaagcttttagtttacagggagtttccatgaagccacaaactaaactaattatca

SEQ ID NO: 234 - DNA, 379 bp, Homo sapien
gagggcagccctcctacctgcgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcacagatgtctctgagttgacgggatttctgaaatgttggggggacgtgtgaaaactttgcatcctgcacgatcccatgctggaatcctagctcctaatattcagaagataatgcttgacatgcgccacacttgattcaatcttataacaattgttgcc

SEQ ID NO: 235 - DNA, 406 bp, Homo sapien
caggctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggttt

SEQ ID NO: 236 - DNA, 278 bp, Homo sapien
gagattagcacctgtgaacaatgcgttctctgatgacactctgagcatggaccaacgccttcttaagctaattctgcaaaatcacatattgaaagtaaaagttggccttagcgacctctacaatggacagatactggaaaccattggaggcaaacaactccgagtctttgtgtatcggacggctatctgcatagaaaactcatgcatggtgagaggaagcaagcagggaaggaacggtgccattcacatattccgagagatcatccaaccagcagaat

SEQ ID NO: 237 - DNA, 322 bp, Homo sapien
cagggccgtggcggaggaggagcgctgcacggtggagcgtcgggccgacctcacctacgcggagttcgtgcagcagtacgtgcgcccctgatcgcggaggtcgcgtcctgttcaccggcccgtctgccccgaccgcccaaggccgccttcccctgacctcgcgcgcacgcgtggggctggggcggcgaggctggcggtccggcctggccgcgactctgcccttctttccagaggttccgggccctgtgctcccgcgacaggttgctggcttcgtttggggacagagtggtccggtgagcaccgccaacacctactcctacct

SEQ ID NO: 238 - DNA, 613 bp, Homo sapiens
  misc_feature (399): n=A,T,C or G
gaattcggcaccagccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggnacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctg

SEQ ID NO: 239 - DNA, 613 bp, Homo sapiens
gaattcggcaccaggggacactggtgctgagctggatgatgatcagcactggtctgacagcccgtcggatgctgacagagagctgcgtttgccgtgcccagctgagggggaagcagagctggagctgagggtgtcggaagatgaggagaagctgcccgcctcaccgaagcaccaagagagaggtccctcccaagccaccagccccatccggtctccccaggaatcagctcttctgttcattccagtccacagcccctcaacagaggggccccaactcccacctgtccctgccgccacccaggagaaatcacctgaggagcgccttttccctgagcctttgctccccaaagagaagcccaaagctgatgccccctcggatctgaaagctgtgcactctcccatccgatcacagccagtgaccctgccagaagctaggactcctgtctcaccagggagcccgcagccccagccacccgtggcggcctccacgcccccacccagcgaggtctccagagccttctctctcctgtgcaaaatggcaactcttaaggaaaaactcattgcaccagttgcggaagaagaggcaacagttccaaacaataagatcactgta

SEQ ID NO: 240 - DNA, 585 bp, Homo sapiens
gaattcggcacgaggtgagatctacgatgaactttaagattggaggtgtgacagaacgcatgccaaccccagttattaaagcttttggcatcttgaagcgagcggccgctgaagtaaaccaggattatggtcttgatccaaagattgctaatgcaataatgaaggcagcagatgaggtagctgaaggtaaattaaatgatcattttcctctcgtggtatggcagactggatcaggaactcagacaaatatgaatgtaaatgaagtcattagcaatagagcaattgaaatgttaggaggtgaacttggcagcaagatacctgtgcatcccaacgatcatgttaataaaagccagagctcaaatgatacttttcccacagcaatgcacattgctgctgcaatagaagttcatgaagtactgttaccaggactacagaagttacatgatgctcttgatgcaaaatccaaagagtttgcacagatcatcaagattggacgtactcatactcaggatgctgttccacttactcttgggcaggaatttagtggttatgttcaacaagtaaaatatgcaatgacaagaataa

SEQ ID NO: 241 - DNA, 566 bp, Homo sapiens
gaattcggcaccaggcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctg

SEQ ID NO: 242 - DNA, 556 bp, Homo sapiens
gaattcggcacgagcaaaggtgaagcaggacatgcctccgcccgggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacctggaaaaaaaaaaaaaaaaaaaaaaaaaaaaaaaaaaaaaaactcgag

SEQ ID NO: 243 - DNA, 591 bp, Homo sapiens
gtctatgtttgcagaaatacagatccaagacaaagacaggatgggcactgctggaaaagttattaaatgcaaagcagctgtgctttgggagcagaagcaacccttctccattgaggaaatagaagttgccccaccaaagactaaagaagttcgcattaagattttggccacaggaatctgtcgcacagatgaccatgtgataaaaggaacaatggtgtccaagtttccagtgattgtgggacatgaggcaactgggattgtagagagcattggagaaggagtgactacagtgaaaccaggtgacaaagtcatccctctctttctgccacaatgtagagaatgcaatgcttgtcgcaacccagatggcaacctttgcattaggagcgatattactggtcgtggagtactggctgatggcaccaccagatttacatgcaagggcaaaccagtccaccacttcatgaacaccagtacatttaccgagtacacagtggtggatgaatcttctgttgctaagattgatgatgcagctcctcctgagaaagtctgtttaattggctgtgggttttccactggatatggcgctgctgt

SEQ ID NO: 244 - DNA, 594 bp, Homo sapiens
gaattcggcacgagaacagagtgaactgagcatcagtcagaaaaagtctatgtttgcagaaatacagatccaagacaaagacaggatgggcactgctggaaaagttattaaatgcaaagcagctgtgctttgggagcagaagcaacccttctccattgaggaaatagaagttgccccaccaaagactaaagaagttcgcattaagattttggccacaggaatctgtcgcacagatgaccatgtgataaaaggaacaatggtgtccaagtttccagtgattgtgggacatgaggcaactgggattgtagagagcattggagaaggagtgactacagtgaaaccaggtgacaaagtcatccctctctttctgccacaatgtagagaatgcaatgcttgtcgcaacccagatggcaacctttgcattaggagcgatattactggtcgtggagtactggctgatggcaccaccagatttacatgcaagggcaaaccagtccaccacttcatgaacaccagtacatttaccgagtacacagtggtggatgaatcttctgttgctaagattgatgatgcagctcctcctgagaaagtctg

SEQ ID NO: 245 - DNA, 615 bp, Homo sapiens
  misc_feature (105): n=A,T,C or G
gtccctttcctctgctgccgctcggtcacgcttgtgcccgaaggaggaaacagtgacagacctggagactgcagttctctatccttccacagctctttcaccatnctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgcttgttaactggattgagtccagctcttgggatggacggtatgccctggtaagttgcaggagatattgctgtatatgccacaggaaatgctagacctac

SEQ ID NO: 246 - DNA, 546 bp, Homo sapiens
gaattcggcaccaggctgcctcccgctcgccctgaacccagtgcctgcagccatggctcccggccagctcgccttatttagtgtctctgcaaaaccggccttgtgaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtgggtgggtgtccacggagatgcagagctccgagagtaagga

SEQ ID NO: 247 - DNA, 564 bp, Homo sapiens
gaattcggcaccagagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatga

SEQ ID NO: 248 - DNA, 434 bp, Homo sapiens
gttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtggagcccagtgacaccatcgagaacgtcaaagcaaagatccaggacaaggaaggcattcctcctgaccagcagaggttgatctttgccggaaagccagcctgggaagatggggccgcca

SEQ ID NO: 249 - DNA, 416 bp, Homo sapiens
gcgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacac

SEQ ID NO: 250 - DNA, 504 bp, Homo sapiens
gaattcggcacgaggcgggtaacgttatagtatttgtcagaagttggggtctccgtgggcattgtgatccgtcccaggcagtggattaggaggccagaaggagatcccttccacggtgctaggctgagatggatcctctcagggcccaacagctggctgcggagctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgtcatctgtgaagactgccaggcctagctct

SEQ ID NO: 251 - DNA, 607 bp, Homo sapiens
gatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatgccccagctgaatctgttgcttaccatgcccaaaataatcctccagttcctccaaagccacagccaaaggttcaggaaaaggcagatatccctgtaaaaagttcacctcaagctgcagtgccctataaaaaagatgttgggaaaaccctttgtcctctttgcttttcaatcctaaaaggacccatatctgatgcacttgcacatcacttacgagagaggcaccaagttattcagacggttcatccagttgagaaaaagctcacctacaaatgtatccattgccttggtgtgtataccagcaacatgaccgcctcaactatcactctgcat

SEQ ID NO: 252 - DNA, 618 bp, Homo sapiens
gaattcgcaccaggggtcctgctggtcttcgcctttcttctccgcttctaccccgtcggccgctgccactggggtccctggccccaccgacatggcggcggtgttgagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagaggatgttaaacgtctgaatgaaaaacttaaagaaagcaatacaacaaagggtgaacttcagttaaaattggatgaacttcaagcttctgatgtttctgtt

SEQ ID NO: 253 - DNA, 1201 bp, Homo sapiens
gaattcggcaccagggtggcgagcgcggctgctgtgctggggcgagcagcggggaccgtgtgtgagtttggcatgatttggtcccctgggattctgccttagcaagaaagaagttggaaatacttcctggaagaaaactaaaacaatacaaaagccacagcttattgattgcatgtcagcccccttacaaatatggacacatttcctagcctatttccacctggaggagatagtaggctgaatcctgagcctgagttccaaaatatgttaattgatgaaagggtacgctgtgaacatcataaacataattatcaggctctgaaaattgaacacaaaaggttgcaggaagaatatgtaaaatcacaaaatgaacttaaacgtgtattaattgaaaagcaagcaagccaggaaaaattccaactgctccttgaagacttaaggggagaattagtagagaaagctagagacatagaaaaaatgaaactgcaggtactaacaccacaaaaattggaattggtaaaagcccaactacaacaagaattagaagctccaatgcgagaacgttttcggactcttgatgaagaagtggaaaggtacagagctgagtataacaagctgcgctacgagtatacatttctcaagtcagagtttgaacaccagaaagaagagtttactcgggtttcagaagaagagaaaatgaaatacaagtcagaggttgcacgactggagaaggacaaagaggagctacataaccagctgcttagtgttgatcccacgagagacagcaaacgaatggagcaacttgttcgagaaaaaacccatttgcttcagaaattgaaaagtttagaggctgaagtagcagaattaagggctgagaaagaaaattctggtgctcaggtagaaaatgtccaaagaatacaggtgaggcagttggctgagatgcaggctacactcagatccttggaggctgaaaagcagtcagctaaactacaagctgagcgtttagaaaaagaactacaatcaagcaatgaacagaatacctgcttaatcagcaaactgcatagagctgaccgagaaatcagcacactggccagtgaagtgaaagagcttaaacatgcaaacaaactagaaataactgacatcaaactggaggcagcaagagctaagagtgagctcgaaagagaaaggaataagatccaaa

SEQ ID NO: 254 - DNA, 560 bp, Homo sapiens
gaattcggcaccagtttggggggtgaggtttaattggaaatggtctctggggactgaaaactgatgtttttgcagattacctcagggaaacggaggtttgttgagttacagacacattaaaccaaaggccgtgggaaaacccctctccagctccaggggattggtcaggaccacccactaaccagtgccttccttcttaacattcacttttagcagcttgtgtttattttacatgggcagttttgatgggaaattgccatgaccacaggggtttggagttctgctttttttttttcttcttctttttcgggggactgggggactcctcccaagatcacattttagcatctttctctcctactccatttagaaaaataagtaacaggtgaaatgtggtctcagtgttaacgggataattctgctaccggctcctccctgatgattctgaaatacactactgaacgagctctggctggtcctttctatcctggatgtggttcttctgtgtagcaattccttgatgtccagtttggaaagatgtactcttctcaacaagaaaa

SEQ ID NO: 255 - DNA, 612 bp, Homo sapiens
gaattcggcaccaggcggggcagcagggccgcggccatggggagcttgaaggaggagctgctcaaagccatctggcacgccttcaccgactcgaccaggaccacagggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaaggtccaagacaactttgacaagattgaattcaataggatgtgttggaccctctgtgtcaaaaaaaaacctcacaaagaatcccctgctcattacagaagaagatgcatttaaaatatgggttattttcaactttttatctgaggacaagtatccattaattattgtgtcagaagagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggacc

SEQ ID NO: 256 - DNA, 1132 bp, Homo sapiens
gaattcggcacgaggtctgggagaggcctctggagcaggaggcccagtggctcttctgacccaaggccccgccgtccagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagc

SEQ ID NO: 257 - DNA, 519 bp, Homo sapiens
gaattcgtgacacgaggtgctcgagatgaaccccagcgcccccagctaccccatggcctctctgtacgtgggggacctgcaccccgacgtgaccgaggcgatgctctacgagaagttcagcccggccgggcccatcctctccatccgggtctgcagggacatgatcacccgccgctccttgggctacgcgtacgtgaacttccagcagccggcggacgcggaacgtgctttggacaccatgaattttgatgttataaagggcaagccagtacgcatcatgtggtctcagcgtgatccatcacttcgcaaaagtggagtaggcaacatattcattaaaaatttggacaaatccatcgacaataaagcactatatgatacgttttctgcgtttggtaacatcctttcatgtaaggtggtttgtgatgaaaatggctccaagggctatggatttgtacactttgaaacacaggaagcagctgaaagagctattgaaaaaatgaatgggatgcttctaaatga

SEQ ID NO: 258 - DNA, 596 bp, Homo sapiens
gctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtg

SEQ ID NO: 259 - DNA, 595 bp, Homo sapiens
gaattcggcaccagagaaaaagcttcaaggtatattgagtcagagtcaagataaatcacttcggagaatttcagaattaagagaggagctgcaaatggaccagcaagcaaagaaacatcttcaggacgagtttgatgcatgtttggaggagaaagatcagtatatcagtgttctccagactcaggtttctcttctaaagcagcgattacagaatggcccaatgaatgttgatgctcccaaacccctccctcccggggagctccaggcagaagtgcacggtgacacggagaagatggagggcgtcggggaaccagtgggaggtgggacttccgctaaaaccctggaaatgctccagcaaagagtgaaacgtcaggagaatctgcttcagcgctgtaaggagacaattgggtcccacaaggagcagtgcgcactgctgctgagtgagaaggaggcactgcaggagcagttggatgaaaggctgcaggagctggaaaagatgaaggggatggtaataaccgagacgaagcggcaaatgcttgagaccctggaactgaaagaagatgaaattgctcagcttcgtagtcatatcaaacag

SEQ ID NO: 260 - DNA, 994 bp, Homo sapiens
gaattcggcacgaggcgttgcctgccttcttgctgtctatcagcctttcttgcctcttccttttcgccttccctgttcttccctttctcaaacaaacaagacatggcaaaccgcagtctaacccagccctttgaaattatccatagttttacagacagctccaggccatgagccacaatgtccaaaattattcttgagcactgatataaattacttagaccttctttgagggcagaactcagctgttgctctcatgatgggcagtgctggaaagggttctggtatgtcttcaaaatgagtccacgagtttactgagtgcttacaggtaaaggaatgaatataagatgtctttctgatcagaacaggtgtcccttcacatgagctttactagactctgggagggaaaagtagccaagtacttctgaaccattttttaatacttgttttgtcatggtgaaattatagcagttatcccaaaatgttttaattatcaaaatactgtcttttaaaaaaaaaaaaaagtaacaccttttaaagcattagatttcacttgggtttcttttccaaaaaatgctaggtagacaaggcattgtaaacatgagtttcctttaagaaccatcagaatataaatttaacatgaagaaaactgctatatctagtagaaataatatctaaagtttaacaactaaagtaccctcacagaatagcaaatacccttctgttctggacatgggttcaaatttgaatatggaaataatttccttggaagtccctagaggcaggtcagaggaagtatgcattaagagggaaaggagagaatggaaataaaagtcactataatgcagatttatgccttattttttagcattttttaaatgttgggtctttcaaggtgttttttgctttttattagatctatataaataagttaactagcaatttagttttgtatttaagctacacttaatctttttctttggtgatatttatttct

SEQ ID NO: 261 - DNA, 594 bp, Homo sapiens
  misc_feature (538): n=A,T,C or G
gaattcggcaccagtggagatccagctgaaccatgccaaccgccaggctgcggaggcaatcaggaaccttcggaacacccagggaatgctgaaggacacacagctgcacctggacgatgctctcagaggccaggacgacctgaaagagcagctggccatggttgagcgcagagccaacctgatgcaggctgagatcgaggagctcagggcatccctggaacagacagagaggagcaggagagtggccgagcaagagctactggatgccagtgagcgcgtgcagctcctccacacccagaacaccagcctcatcaacaccaagaagaagctggagacagacatttcccaaatccagggagagatggaagacatcgtccaggaagcccgcaacgcagaagagaaggccaagaaagccatcactgatgccgccatgatggcggaggagctgaagaaggagcaggacaccagcgcccacctggagcggatgaagaagaacatggagcagaccgtgaaggacctgcagcaccgtctggacgangctgagcagcttggcgctgaagggcgggcaagaagcagatccagaaactggaggct

SEQ ID NO: 262 - DNA, 594 bp, Homo sapiens
gaaaaggtggctggagccaaaggcatagtcagggttaatgctcctttttctttatcccaaatcagatagtgtttaggctttttcatcaaatataaaaacccagcccagttcatggctcattcggcagcaaccctgagacgctttacagctctagaccctaaaaggtcaaaaggccgtcttatgctcaatatacattttattacccaatctgccccggacattaaataaaactccaaaaattaaatccggccctcaaaccccacaacaggacttaattgacctcaccttcaaggtgtagaataataaaaaaaaaaagttgcaattccttgcctccgctgtgagacaaaccccagccacatctccagcacacaagaacttccaaacgcctgaaccacagcagccaggcgttcctccagaacctcctcccccaggagcttgctacatgtgccggaaatctggccactaggccaaggaatgcctgcagccccggattcctcctaagccgtgtcccatctgtgcgggaccccactgaaaatcggactgttcaactcacctggcagccactctcagagaccctggaactctggcccaagg

SEQ ID NO: 263 - DNA, 506 bp, Homo sapiens
gaattcggcacgagcggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactataaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttttaaaaaaaaaaaaaaaaaaaaaactcgag

SEQ ID NO: 264 - DNA, 600 bp, Homo sapiens
  misc_feature (32): n=A,T,C or G
ggctcgtgaacacacactgacagctatagggnaggcggcggcaccgtccccgcttcccctcggcggcggggtgtcccgtcggcggccctgaagtgacccataaacatgtcttgtgagaggaaaggcctctcggagctgcgatcggagctctacttcctcatcgcccggttcctggaagatggaccctgtcagcaggcggctcaggtgctgatccgcgaggtggccgagaaggagctgctgccccggcgcaccgactggaccgggaaggagcatcccaggacctaccagaatctggtgaagtattacagacacttagcacctgatcacttgctgcaaatatgtcatcgactaggacctcttcttgaacaagaaattcctcaaagtgttcctggagtacaaactttattaggagctggaagacagtctttactacgcacaaataaaagctgcaagcatgttgtgtggaaaggatctgctctggctgcgttgcactgtggaagaccacctgagtcaccagttaactatggtagcccacccagcattgcggatactctgttttcaaggaagctgaatgggaaatacagacttgagcgacttgtt

SEQ ID NO: 265 - DNA, 534 bp, Homo sapiens
gaattcggcacgagtgaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcc

SEQ ID NO: 266 - DNA, 552 bp, Homo sapiens
gaattcggcaccagggcacctccgcctcgccgccgctaggtcggccggctccgcccggctgccgcctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaaga

SEQ ID NO: 267 - DNA, 551 bp, Homo sapiens
gaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctg

SEQ ID NO: 268 - DNA, 573 bp, Homo sapiens
gaattcggcaccagggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaa

SEQ ID NO: 269 - DNA, 500 bp, Homo sapiens
gaatcggcaccaggaaacctttattagcagagatagctggcttggatcagattacggggaatgtgggggagccatgaagaaactaactaaaggggagcctttggggaccagggggagacaagtcactattttgagggagaaagctctggattgattctgacaggacacttgagtgtgaactgtccaagctaagcctctgggtgtgtagagagagcccttacagatagatagcacctttgctttcagagtggaaggactagccactaaggaccagaccaagatgcatgtaggtcactgacaagcacctgatgaagaggaggggtctcctccaagtttgtgtttggaactcctcctgtgttcaatttcctaaaagccataatccagcaagctgaactcatgagaaggtctgcttcatgttgagcatggaagacagaacacagacggaaactgcagtgatggtgtgaagacaccacggataggttaggggcagtgaggaggaa

SEQ ID NO: 270 - DNA, 224 bp, Homo sapiens
gaattcggcacgagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagt

SEQ ID NO: 271 - DNA, 447 bp, Homo sapiens
gaattcggcacgaggctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagat

SEQ ID NO: 272 - DNA, 606 bp, Homo sapiens
gcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatgggtatactggagaa

SEQ ID NO: 273 - DNA, 598 bp, Homo sapiens
gaattcggcaccaggcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggcc

SEQ ID NO: 274 - DNA, 536 bp, Homo sapiens
gcaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaa

SEQ ID NO: 275 - DNA, 494 bp, Homo sapiens
  misc_feature (379): n=A,T,C or G
gaattcggcaccagggtcgcggttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtggagcccagtgacaccatcgagaacgtcaaagcaaagatccangacaaggaaggcattcctcctgaccagcagaggttgatctttgccggaaagcagctggaagatgggcgcaccctgtctgactacaacatccagaaagagtctaccctgcacctgg

SEQ ID NO: 276 - DNA, 484 bp, Homo sapiens
ggcttttaaccagaagtcaaacctgttcagacagaaggcagtcacagcagaaaaatcttcagacaaaaggcagtcacaggtgtgcagggagtgtgggcgaggctttagcaggaagtcacagctcatcatacaccagaggacacacacaggagaaaagccttatgtctgcggagagtgtgggcgaggctttatagttgagtcagtcctccgcaaccacctgagtacacactccggggagaaaccttatgtgtgcagccattgtgggcgaggctttagctgcaagccatacctcatcagacatcagaggacacacacaagggagaaatcgtttatgtgcacagtgtgtgggcgaggctttcgtgaaaagtcagagctcattaagcaccagagaattcacacgggggataagccttatgtgtgcagagattgaggccgaggctttgtaaaggagatcatgtctcaacacacaccagaggattacatt

SEQ ID NO: 277 - DNA, 513 bp, Homo sapiens
gcttgaggctgccaatcagagcttggcagagctgagagatcagcggcagggggagcgcctggaacatgcagcagctttgcgggccctacaagatcaggtatccatccagagtgcagatgcacaggaacaagtggaagggcttttggctgagaacaatgccttgaggactagcctggctgccctggagcagatccaaacagcaaagacccaagaactgaatatgctccgggaacagaccactgggctggcagctgagttgcagcagcagcaggctgagtacgaggaccttatgggacagaaagatgacctcaactcccagctccaggagtcattacgggccaatagtcgactgctggaacaacttcaagaaatagggcaggagaaggagcagttgacccaggaattacaggaggctcggaagagtgcggagaagcggaaggccatgcttggatgagctagcaatggaaacgctgcaagagaagtcccacacaaggaagagcttgggagcagttc

SEQ ID NO: 278 - DNA, 471 bp, Homo sapiens
gaattcggcaccagccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactt

SEQ ID NO: 279 - DNA, 497 bp, Homo sapiens
  misc_feature (457): n=A,T,C or G
  misc_feature (471): n=A,T,C or G
gaattcggcacgaggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcanctgtcctacatcancttccagacccagacagtcatccaca

SEQ ID NO: 280 - DNA, 544 bp, Homo sapiens
  misc_feature (451): n=A,T,C or G
gaattcggcaccagaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcacaaggggtcagggagttccctttccgagtcaaagaaaggggtgacggacgcacctggaaaatcgggtcactcccacccgaatattgtgcttttcagaccggcttaagaaacggcgcaccacgagactatatcccacacctggctcagagggtcctacgcccacggaatctcgctgattgctagcacagcagtcttagatcaaactgcaaggggggcaacgaggctgggggaggggcgcccgccattgcccangcttgcttaggtaaacaaagcagccgggaagcttgaactgggtggagcccaccacagctcaaggaggcctgcctgcctctgtagctccacctc

SEQ ID NO: 281 - DNA, 527 bp, Homo sapiens
  misc_feature (456): n=A,T,C or G
gaattcggcacgaggcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcanggcccccctgccaatagtaataaagcaatgtccttttttaaaacatgaaaaaaaaaaaaaaaaaactcgag

SEQ ID NO: 282 - DNA, 514 bp, Homo sapiens
  misc_feature (494): n=A,T,C or G
ggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtanacccaaatgtggctcaacac

SEQ ID NO: 283 - DNA, 484 bp, Homo sapiens
gggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtgccgttaattaaggaaaagttgagccagggcgtgaccctcgtcgtggacagatacgcattttctggtgtggccttcaccggtgccaaggagaatttttccctagactggtgtaaacagccagacgtgggccttcccaaacccgacctggtcctgttcctccagttacagctggcggatgctgccaagcggggagcgtttggccatgagcgctatgagaacggggct

SEQ ID NO: 284 - DNA, 514 bp, Homo sapiens
gaattcggcacgaggcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgaga

SEQ ID NO: 285 - DNA, 383 bp, Homo sapiens
gaattcggcacgaggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcc

SEQ ID NO: 286 - DNA, 943 bp, Homo sapiens
gaattcggcaccagggccgtggcggaggaggagcgctgcacggtggagcgtcgggccgacctcacctacgcggagttcgtgcagcagtacgtgcgcccctgatcgcggaggtcgcgtcctgttcaccggcccgtctgccccgaccgcccaaggccgccttcccctgacctcgcgcgcacgcgtggggctggggcggcgaggctggcggtccggcctggccgcgactctgcccttctttccagaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatggtgaggcagccctaggcggcggtagggggtggggacgcttggagtctccaggtgccaggatccctgtccccgccgtctctgttggcagacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacactggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcc

SEQ ID NO: 287 - DNA, 1143 bp, Homo sapiens
gaattcggcacgagggaagaacagctgttggaacaacaagaatatttagaaaaagaaatggaggaagcaaagaaaatgatatcaggactacaggccttactgctcaatggatccttacctgaagatgaacaggagaggcccttggccctctgtgaaccaggtgtcaatcccgaggaacaactgattataatccaaagtcgtctggatcagagtatggaggagaatcaggacttaaagaaggaactgctgaaatgtaaacaagaagccagaaacttacaggggataaaggatgccttgcagcagagattgactcagcaggacacatctgttcttcagctcaaacaagagctactgagggcaaatatggacaaagatgagctgcacaaccagaatgtggatctgcagaggaagctagatgagaggaaccggctcttgggagaatataaaaaagagctggggcagaaggatcgccttcttcagcagcaccaggccaagttagaagaagcactccggaaactctctgatgtcagttaccaccaggtggatctagagcgagagctagaacacaaagatgtcctcttggctcactgtatgaaaagagaggcagatgaggcgaccaactacaacagtcacaactctcaaagcaatggttttctccttccaacggcaggaaaaggagctacttcagtcagcaacagagggaccagcgacctgcagcttgttcgagatgctctccgcagcctgcgcaacagcttcagtggccacgatcctcagcaccacactattgacagcttggagcagggcatttctagcctcatggagcgcctgcatgttatggagacgcagaagaaacaagaaagaaaggttcgggtcaagtcacccagaactcaagtaggtagtgaataccgggagtcctggccccctaactcaaagttgcctcactcacagagctctccaactgtcagcagcacctgtactaaagtgctctatttcactgaccggtcacttacgcccttcatggtcaatataccaaagaggttggaggaggtgacgttaaaggattttaaagcagctattgatcgggaaggaaatcaccggtatcacttcaaagcactggatcctgagtttggcactgtcaaagag

SEQ ID NO: 288 - DNA, 881 bp, Homo sapiens
gtgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaaaaaaaaaaaaaaaaaactcgag

SEQ ID NO: 289 - DNA, 987 bp, Homo sapiens
gaattcggcacgagggactgtggtttccaggaatggtggcgtctcacgcttcttgtgctttttcctttggggcctccgagcggctggggttgggggactgggcaggaggctccctgtaaacatttggacttgggctggggcaggggctggtgttgggcaaagctgggggtccaggctggagaagcaggggcccctccagacgcagccttgggagactcagcatgtgcccccctcccctcatcacagaacaagacaatggttaaaaaccagaacagatgcccagaagggggtaccatggccattaccagcatctcagacaagggcaggcttcaaacagggaggcctgtggcaacccctcccctacgtctggagctgaggggacagggggagctgagaacaaagagaggaaagaggagaaaagcggcgggggaacaggcggggagcgtgatcttcttgcccccatcttcctcaggggttggggggtacaaagtcggcggtggcccatcccgccaggccccgctgcccctcagaagaggccgcagtccttcaggttgttcttgatgatgacatcggtgacggcgtcaaacacgaactgcacgttcttggtgtcggtggcgcacgtgaagtgcgtgtagatctccttggtgtctttgcgcttattcaggtcctcaaacttactctggatgtagctggctgcctcatcatatttgttggcccctgtatactcagggaagcagatggtcaggggactgtgtgtgatcttctcctcaaacaggtccttcttgttgaggaagaggatgatggacgtgtctgtgaaccacttgttgttgcagatgctatcgaatagcttcatgctctcatgcatgcggttcatctcctcgtcctcagctagcaccaagtcataggcgctcaaggctacgcagaagatgatggctgtgacgccctcaaagcagtggatccacttcttccgctcagaccgctgaccac

SEQ ID NO: 290 - DNA, 300 bp, Homo sapien
  misc_feature (1)...(300): n = A,T,C or G
gattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacancttgactcctacangaatgggtgcctcaacttgagccctgcctttctttggtttctctgaacccctt

SEQ ID NO: 291 - DNA, 352 bp, Homo sapien
  misc_feature (1)...(352): n = A,T,C or G
aaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatngggtgggcncctttcctcaggtagagnggggggccaaaacctctgcngtccccggagngagctatggactttcttccccctcacaaggntgggggcctcctgct

SEQ ID NO: 292 - DNA, 511 bp, Homo sapien
  misc_feature (1)...(511): n = A,T,C or G
cgcggtggctgcgcactcngcctgagaaactcggcaagcgcgcagtgtcgactccccggtctatgccaggcgcatctcagctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagacataacccacagttatcttgaacaagaaactacggggataaataaaagtacgcanccagatgagcaactgactatgaattctgagaaaagtatgcatcggaaatccactgaattagntaatgaaataacatgngagaacacagaatggccaggggcagagatcaacgaattttcanatcatcagttcttatccagatgatgagtctgtttact

SEQ ID NO: 293 - DNA, 526 bp, Homo sapien
  misc_feature (1)...(526): n = A,T,C or G
gataaaaagaactttaatggaaggcactgttgtccaaaatcacataaagggtaagagcccacacggtaccaccctgctctcctacttctcaaacccacatccaccacccagacaggagggtgcanaccccacaggaaattacctcccggagcactgactgatatttttccttaaaacaaaaaaatggctgtctcagactaataacagaacatcttaagagctataccagctattacagcctggtaatanaagcagctttctaanaattcccaagtttataanaggcccaanaaatgcatttattctgttgtctattaagcctccatgacaaggagaaagttatgagtaaatccttggttcatcaggagttaagagctgtgngcctcatgaggagttaanagctgtgtgcataagcaggttcaagaaacaaactcctgtttgtttgcctctttgatggttcaaaaacattcagctgctttcacctctangacaaaatgcttaaagaatttactctcatcaccttggg

SEQ ID NO: 294 - DNA, 601 bp, Homo sapien
  misc_feature (1)...(601): n = A,T,C or G
actttaaaagccaaatatatttttaaaagatcatgcttataataagtaaattacncattaaggaaacatcaaaataaagtagatgaataaaaaggcacactcgaaaaatttgagcgcagaaaggacagttctttttgttttgtttctaatgtcggaagaaaaagaaagagatatattaaaatcattgttttcaagtgaaggtttctgtcagttgaagtagttagcaatggcttcttttctcccgtgtccaaagcaggctcttcctgcgctgacttctgaggaggngttcagtcctctgccatgtataggcgatacatcaaggcgacggccactgcagagatggcagggatcacccagttggtccaccaactggaactagaatcaatagtagtgataagagtttccggaggcttgtttaactttggtctgtcatctggatggagctccccaatgatgaatgttttggacatttccctggcatctgtagantgcccgacatcctcaaagttctcagtagcngtcacctccacttgttcccttaaaacttcttccccaccaggatgctcttccagaaatttgggncaaatcgnacaccttgtgg

SEQ ID NO: 295 - DNA, 262 bp, Homo sapien
cccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttcc

SEQ ID NO: 296 - DNA, 598 bp, Homo sapien
  misc_feature (1)...(598): n = A,T,C or G
gttagaacaactcagcaaaataaaattcctgtttattgttggacaacattgtttcacacatacatcaaacaggccaaaaaaaataaacagcaacttcatagacaaaaaaggaaaaaaaaagaaaccttttatctttggcctttttaaccatctcatacaaaccaactacttatagtacagctaagtacatacacaaaaaagttactggaatgctcggaataagattgtttttctgttgtcatttttgctttttttacaaggntttttttctcctttgagattataatgaacatggncacaccacaagtaaagtcagaagtaggacaganaacgctccgaaggctggtttggtcatccganatcattaaaaatggctgaccctaacaatatgtacaaaaatataaaatgtaaataaaaaatacaaacaaatttcctttttaaagtacttttaagaaaaaaagcagggccttggaagttttggttcttttttcctcccctgttgcaaattctcatggtttgggttgggtggngganancccgtgtcatctgcgggtggcactgccccggngggcgggcgggcctctctctcgaangngac

SEQ ID NO: 297 - DNA, 509 bp, Homo sapien
agaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcaggacccgagagcatgcccttctggcttacacactgggtgtgaaacaactaattgtcggtgttaacaaaatggatt

SEQ ID NO: 298 - DNA, 267 bp, Homo sapien
  misc_feature (1)...(267): n = A,T,C or G
gggacgggggaaaggagacgcttcttcctcttgctgctcttctcgttcccgagatcagcggcggcggtgaccgcgagtgggtcggcaccgtctccggctccgggngcnaacaatgctgactgatagcggaggcggnggcacctccttnnaggaggacctggactctgtggctccgcgatccgccccagctggggcctcggagccgcctccgccgggaggggtcggtctggggatccncaccgngaggctntttggggagggcgggcc

SEQ ID NO: 299 - DNA, 121 bp, Homo sapien
ggcacgagggccctcggagctcgtttccagatcgaggtaagagggactttcttaaaggcctagtctatgggatggggcggcggagggaattttttgagaaataaaatgaagctgcagtgta

SEQ ID NO: 300 - DNA, 533 bp, Homo sapien
aaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttacctt

SEQ ID NO: 301 - DNA, 560 bp, Homo sapien
  misc_feature (1)...(560): n = A,T,C or G
ataaatgatcccttttattgtaagtaatgcgcaacactggcctggctttgcactgcaagccctcggtcaagatatagtcaaataactatggctgcaggttccacagttccacaataaccatggctgcacgatccacaattcagacacagacatagagctggggtgggtggaaggggcaggagggtggcagagtgcggactgtccccagccctggcctctccatgcanagttggcccaggcagacacaccccatggaatgatgagaaagtgacggcacggccccttcccacagcaagcctggggctgccaggaactgcccttcanaacctttgggcccaggtcnccctgaanccccacaactttttatctggaataagtattaaaaaacaataaattaagcaaacaacntggnccttgaaggatgttgaccnacatggtccacagtttttggcncaaaaaaataagggctggtttgctttttttggaaggcagggtttgtggnttggctttcaaatnattttcaaaccattccccagggaggganaacccccgggggggaa

SEQ ID NO: 302 - DNA, 599 bp, Homo sapien
  misc_feature (1)...(599): n = A,T,C or G
gcaaagttacaaatttattggtctggaaataaatacaaatatctcattaanaaactcctctggaaagacttgtgcacaatagtttcccatccgtactcagcctctcttgccccgatccccgacttttctactcaaggccagggaaggcctccaaggngatgggcggcaggtaacgagtcattgcctctcacgccacctggaaggctggactacttcctcctcccaactgcggggtcccanaaatcctcgggtcccagnggctgacttacaatattcaattcactctgaccaaacttcctatganaaaatccacggngagccaaaatgaaaagtacaaggcagtagtacaggaacctggcagccgcactggccgcccanaaacgtcagtggngctgccccattcggcgaaaggttagggagcaggaaaagaggaagcaggagagggaaggaaagtcccatggaatatgtattccanaatccttacattttctcagccaccgctccccacgtgagttcccacccccaccccgacaagaagcaaagagttctgaggatccaagaacgtgaccgggtcanacangttcagctactgagttcac

SEQ ID NO: 303 - DNA, 591 bp, Homo sapien
cggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcg

SEQ ID NO: 304 - DNA, 441 bp, Homo sapien
  misc_feature (1)...(441): n = A,T,C or G
gctggacggagacctgctggaggaggaggagctggaggaagcagaggaggaggaccggtcgtcgctgctgctgctgtcgccgcccgcggccaccgcctctcagacccagcagatcccaggcgggtccctggggtctgtgctgctgccagccgccaggttcgatgcccgggaggcggcggcggcggcgggggtgctgtacggaggggacgatgcccagggcatgatggcggcgatgctgtcccacgcctacggccccggcggttgtggggcggcggcggccgccctgaacggggagcaggcggccctgctccggagaaagagcgtcaacaccaccgagtgcgtcccggtgcccagctccgagcacgtcgccgagatcgtcggccgccagggttgtaaaattaaagcactganagccaagacaaacacgtatatcaagactcc

SEQ ID NO: 305 - DNA, 491 bp, Homo sapien
tcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcacccgcgcgtgc

SEQ ID NO: 306 - DNA, 547 bp, Homo sapien
  misc_feature (1)...(547): n = A,T,C or G
tctctttcttttaagacaggaatgtaagccacaacatttacaaatacaatgttttaactctctacatgtaggaagccaacctgctcctttttgatcttcttctttggcacaacctcagtggatttctctgattcagaacgagttctaattgatcttctctgttgcttcttttctactgagcctgtagaaccagatgttgcttcaggagatgatacactctgcgttggcttttcatttctctggtttggtgtagaaattataagcctgtcttgccccctgacacttatttctgttttgttaccaattccctttgttgaataaacaaattgatcgataaatttcccatcccctgtagcattctgaagagcaaacacttgttcaattttcacaactggagacatgttacacttctgcaaatccaggctccctttgtgcatccgtaatggaagctggtaaggatttccttgctgccgcagttttccaggctattttaacaggcggnggctcttcctctttccgcacttgtgtgccgcctctggctatgtct

SEQ ID NO: 307 - DNA, 571 bp, Homo sapien
  misc_feature (1)...(571): n = A,T,C or G
cgctgcatgtgataatgtcatcatttatttttaaatggttctaaattgcanatttaagttgatttcaaatcaaccctatttttaaattacttttaataggaanaaatgaagcaaggacatacataatctactatatttgaaggactcaaacaaatacatgtttggctgtgaattctgtactctcaccaaaacagagataaaaatccacctaaaatacactttccttcatttagtgcttgtggganaaggtcaagtattgcactttaaaattactttcatctaacatttgccccaactttccccctgaattcactatatgttttcagcaaacatgattttataaattttaagtataaaagcaactaggttttctaattcaactttggaaggtttactttactctacanagctatttttgtaaaacggcatatttacttacaaaattganagataggggcatccagctgaggtacatttcctcccttggcgttgagtttctggacttgggtcgggggcacaggcttgtgtgactgccccgtggcccgatacatggcctggaccccaggatgcg

SEQ ID NO: 308 - DNA, 591 bp, Homo sapien
  misc_feature (1)...(591): n = A,T,C or G
ctccttatgtgtctgcctacttcattcttcggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttgggggagcaaaggagaaatntgtggaccgaagcat

SEQ ID NO: 309 - DNA, 591 bp, Homo sapien
agggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgaggtaagtaagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctgctgagattgagagctgctgagtggcagtgctccagaatcacgggatggggccttctgtttcagctctgcgtacgtgtcctatgggggcctgctcatgaggctgcagggggatgccaacaacctgcatggattcgaggtggactccagagtttatctcctgatgaagaagctagcctt

SEQ ID NO: 310 - DNA, 488 bp, Homo sapien
tggtctcaagcctgaagaggctccgcccacaagctggcccatgaagttagcaatgcctgtggcttcagtcaattgtcttgagactgtgaagaggctgaaagacaccttcccgggtggaagaaggagttcactgaaaacttatcttaaactgacccttccctttgagtgagtcttcattcctctcccatgtgggaacccagcctccgatgccccggggactaggggaaacagttggaggtccgtgccgtccccagcctgccacgggtgcgaggacagccaagtcctgagtgactcaagatgcttcacttacatggaagaaacttctaaaactctaccgagtggtttttgtatatactaaagttctatttagagcttttctgttttgggcaagttcgctgctccttctatttgggcactttggtttttgtactgtcttttgtgacggcattgattgaacattttttactagtagtcttatgacttttgta

SEQ ID NO: 311 - DNA, 511 bp, Homo sapien
  misc_feature (1)...(511): n = A,T,C or G
cccgtttntgnagcaaaanagggggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggtt

SEQ ID NO: 312 - DNA, 591 bp, Homo sapien
gaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagag

SEQ ID NO: 313 - DNA, 373 bp, Homo sapien
  misc_feature (1)...(373): n = A,T,C or G
ttgatttttattctgnattttattactgaaatangttgtcctantnatcccaccccacaataaaaatntnacccangccccccntttctttncctnatnccctnttccaccacaccatcccggaacaagtgctccaggattccctgcccactggccattttggagtgtgnccattgggtagcaatgtggaaaccaccaaggcctttgtgganaaaatggagggggttgagggagncccangaggggctnatttgagggcctttgccacttgctcataggcgagctcnatctcctcntnatctgnacangtggaagcaaattcttcccgggcgtnggnantgctnaagnaccgatgcactccccggaaggnctn

SEQ ID NO: 314 - DNA, 591 bp, Homo sapien
  misc_feature (1)...(591): n = A,T,C or G
cccgtgccgccgccgcctcctgggaagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacngatgtaattctgtgtatcttac

SEQ ID NO: 315 - DNA, 591 bp, Homo sapien
  misc_feature (1)...(591): n = A,T,C or G
aagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggtacagacatgaatgaaggacaactactgggagactttgagattgagtccaaacagctggaagcagagtcttggagtcggataatagacagcaagtttctaaaacagccaaaagaaagatgtgggtcaaacngcgagaagtaatatatgagttggatgcagacagagttt

SEQ ID NO: 316 - DNA, 591 bp, Homo sapien
gtttttataagaataaaattccattcaagccagatggtgtttacattgaagaagttctaagtaaatggaaaggagattatgaaaaactggagcacaaccacacttacattcaatggcttttccccctgagagaacaaggcttgaacttctatgccaaagaactaactacatatgaaattgaggaattcaaaaaaacaaaagaagcaattagaagattcctcctggcttataaaatgatgctagaattttttggaataaaactgactgataaaactggaaatgttgctcgggctgttaactggcaggaaagatttcagcatctgaatgagtcccagcacaactatttaagaatcactcgtattcttaaaagccttggtgagcttggatatgaaagttttaaatctcctcttgtaaaatttattcttcatgaagctcttgtggagaatactattcccaatattaagcagagtgctctagagtattttgtttatacaattagagacagaagagaaaggagaaagctcctgcggttcgcccagaaacactacacgccttcagagaactttatctggggacccgcctcgaaaagaa

SEQ ID NO: 317 - DNA, 323 bp, Homo sapien
ccaagctacggaagcaagtggaagagatttttaatttgaaatttgctcaagctcttggactcaccgaggcagtaaaagtaccatatcctgtgtttgaatcaaacccggagttcttctatgtggaaggcttgccagaggggattcccttccgaagccctacctggtttggaattccacgacttgaaaggatcgtccacgggagtaataaaatcaagttcgttgttaaaaaacctgaactagttatttcctacttgcctcctgggatggctagtaaaataaacactaaagctttgcagtcccccaaaagaccacgaagtcctggg

SEQ ID NO: 318 - DNA, 591 bp, Homo sapien
  misc_feature (1)...(591): n = A,T,C or G
gatggcgtacttggcttggagactggcgcggcgttcgtgtccgagttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaangatgactcaatcatcacttgttttaacaggaaatggtgactattacagtagng

SEQ ID NO: 319 - DNA, 591 bp, Homo sapien
gaattcggcacgaggttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatg

SEQ ID NO: 320 - DNA, 591 bp, Homo sapien
  misc_feature (1)...(591): n = A,T,C or G
ggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctngnggaggcccaagtttgtccaggacaccctnaaaggagacgggngtgacagaaatccggatgagattcatcaggcggattgangac

SEQ ID NO: 321 - DNA, 260 bp, Homo sapien
  misc_feature (1)...(260): n = A,T,C or G
ctgcttggctccacacgtgggccgccgtaggtattccgaccggtaattcctcctattggtgtgcagcagccacattgaaggatagagtggcagcagaggccaaggatcgtgagttgatggagtttgctgctgaaaatgaagggaagtctgggggaggtctccacagcgtagctgagggggtgcggctaagtccagagcctggcagggagggagtaagggacttagcaggggcggaggagttctgcggngganaggagggg

SEQ ID NO: 322 - DNA, 559 bp, Homo sapien
  misc_feature (1)...(559): n = A,T,C or G
ttccacatgacatggagtgtgaagctggatgagcacatcattccactgggaagcatggcanttaacagcatctcaaaactgactnanctcacccagtcttccatgtattcacttcctaatgcacccactctggcanacctgnaggacnatacacatgaagncantgatgatcagccaganaancctcactttgactctcgcanngtgatatttgagctggattcatgcaatggnagtgggaaagtttgccttgtctacaaaagtgggaaaccagnattagcagaanacactgagatctggttcctgnacanancgttatactggcattttctcacanacacctttactgcctattaccgcctgctcatcacccacctgggcctgccccagtggcaatatgccttcccagctatggcattagcccacaggccaagcaatggttcagcatgtataaacctatcacctacaacacaaacctgctcacagaaganaccgactcctttgtgaataagctagatcccanctnagtgtttaagagcaagaacaagatcgttatccc

SEQ ID NO: 323 - DNA, 492 bp, Homo sapien
  misc_feature (1)...(492): n = A,T,C or G
cctgtctcccagccgtaccagcgagggctcggccggcagcgccgggctggggggcggcggcgccggcgccggagccggggtgggtgcaggcggcggcgggggcagcggcgcgagcagcggcggcggggccggggggctgcaacccagcagccgcgctggcggcggccggccctccagccccagcccgtcggtggtgagcgagaaggagaaggaagagttggagcggctgcagaaagaggaggaggagaggaagaagaggctgcagctgtatgtgttcgtgatgcgctgcatcgcctacccctttaatgccaagcagcccaccgacatggctcgccggcagcagaagatcagcaaacagcagctgcagacagtcaaggaccggtttcaggctttcctcaatggggaaacccanatcatggctgacgaagccttcatgaaccgctgtngcagagttactatgaggtgttcctgaagaccacccgtgtggccgca

SEQ ID NO: 324 - DNA, 474 bp, Homo sapien
  misc_feature (1)...(474): n = A,T,C or G
aatttcagcaacatacttctcaatttcttcaggatttaaaatcttgagggattgatctcgcctcatgacagcaagttcaatgtttttgccacctgactgaaccacttccaggagtgccttgatcaccagcttaatggtcanatcatctgtttcaatggcttcgtcagtatagttcttctccagnaactcacgcactgacttggcaccccggcctatggcattggccttccaggcatggtatgtgcccgaggggtcagtctgatagagcctaggagtgccatcaaagtcgaaacccacgatgagggcagagatgccaaacggcctgcgcccattgctctgcgtataacgctgcttcanactggcgatgtagcgggtgatgtactccacagtgaccgggtcctccacagtcagccggtggctctggcactccacccgggccctgttgatgactatccttgcatcggcggtgaggcc

SEQ ID NO: 325 - DNA, 532 bp, Homo sapien
  misc_feature (1)...(532): n = A,T,C or G
gaggagacaggacagagcgtctggagaggcaggaggacaccgagttccccgtgttggcctccaggtcctgtgcttgcggagccgtccggcggctgggatcgagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggctaccgggaccgcagctatgaccctccatgcccaggccactggacgccggaggcacccggctcggggaccacatgccccgggttgcccagacttcagaccctgacgaggncgggggccctgaggg

SEQ ID NO: 326 - DNA, 322 bp, Homo sapien
  misc_feature (1)...(322): n = A,T,C or G
caaaattaacatttttattaaatcaagttaaaaaaaatgttcagtgtanaaaagtcaacaagggttttaacaaaaccaaaatatacctttttatacaatatatgtatatattagcagcaaactacttctganattctctttcttttatgttcttctagttattttaaagaaagcataaacaatgtatattagtatggaatgtcagcaaatccactcttagtcctttattctgtgatttgggccttctacaaaatactttgtgattctcactaatgaatattaagaacatacccaattttaactaaaaagtagtgaaacagtg

SEQ ID NO: 327 - DNA, 387 bp, Homo sapien
aaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttgg

SEQ ID NO: 328 - DNA, 502 bp, Homo sapien
  misc_feature (1)...(502): n = A,T,C or G
agcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccnagagagagaagcagcagtacatgaaggagctgcgggcgtaccagcagtctgaagcctataagatgtgcacggagaagatccaggagaagaagatcaagaaagaagactcgagctctgggctcatgaacactcttctgaatggacacaa

SEQ ID NO: 329 - DNA, 463 bp, Homo sapien
  misc_feature (1)...(463): n = A,T,C or G
caagttgcacattttaatttacaatttttaccaataaaaaggattagtttacaaaaagggaagtcctttatacaaaataaggacaatttgtaaaganaatccactgtcatgttttgccttgtcaagtcaaaactcaaatagcttgttttggtaaaattattccagaaacataatccagacaaaatcaataacgtcatcagcttcctaaccatgtttaanaggaataacttcatgaacattttgccctgaactgaanagttctaaatacttgtaaacctttaggaaaaaatgactgctcgcaggcagcttgactggtaagagggtacaccanagactccgggtcactcactgtcagaatattcttatacatacaatgagtctccacgcctgtacaatgagtgtcgtgcaacataattggagtaatggcctctaaaattttacaagtaaactttattgnggcccc

SEQ ID NO: 330 - DNA, 500 bp, Homo sapien
  misc_feature (1)...(500): n = A,T,C or G
taattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaaacagatgccacctgtgggaagcaagaaaagtagcactagaaaagataaggaagaatctaaaaagaagcgcttttccagtgagtccaagaacaaacttgtncctgaagaagtgacttcaactgtcacgaaaagtcgaanaatttccangcgtccatctgattggtgggtggtaaaancagaggagagtcctgtttatagcaattcttcagtaagaaatgaattaccaantgcatcacaatnntgcccggaa

SEQ ID NO: 331 - DNA, 494 bp, Homo sapien
  misc_feature (1)...(494): n = A,T,C or G
tctctctctctctcaaaattacagtgttcattgtcattgacctcagcagcaaatttgacttgaattcacttaggatcgcaggaatcaggggaaagtgattttaaaggtggtttctccagcacattttaagaaaagggaccaaaagttattttagcttcctcaatagattgcatgttgcttattaggataataaattaatattaaatgcaatatatgtcttgnctttattatggcatctatttaggagttgttcaaatcactgcagtagggctctgcaaataaaataatgnaacctattatcatggatctaatgnactgnaactttatcagtgaaaggnaaaatctcaaataacaagtacaaacattggacaattacctataaagatttgtaaaaggaaaatttttccatagatttcattcttggcattttgtaaagacgaccctgcagncccctgtttgnaacttttttaataaaatagacatctgtttacttg

SEQ ID NO: 332 - DNA, 538 bp, Homo sapien
aaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattga

SEQ ID NO: 333 - DNA, 499 bp, Homo sapien
ctcagcctgcgggactgctcggctcggcttctaggcggttttgatgaacacctggctttattcttgcaatgaagaaaggttctcaacaaaaaatattctccaaagcaaagataccatcatcatctcactctcctatcccatcatctatgtccaatatgagatctaggtcactttcacctttgattggatcagagactctaccttttcattctggaggacagtggtgtgagcaagttgagattgcagatgaaaacaatatgcttttggactatcaagaccataaaggagctgattcacatgcaggagttagatatattacagaggccctcattaaaaaacttactaaacaggataatttggctttgataaaatctctgaacctttcactttctaaagacggtggcaagaaatttaagtatattgagaatttggaaaaatgtgttaaacttgaagtactgaatctcagctataatctaatagggaagattgaaaagtcgga

SEQ ID NO: 334 - DNA, 561 bp, Homo sapien
  misc_feature (1)...(561): n = A,T,C or G
ttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaacccggcccaaaaagaaaaatgccataaacactgagatgtatcatgaaattatgcgtgcacttaaagctgccagcaaggatgactcaatcatcactgttttaacangaaatggtgactattacagtagtgggaatgatctgactaacttcnctgatattccccc

SEQ ID NO: 335 - DNA, 551 bp, Homo sapien
aagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtgggtggatgacaagaagtttgtgagcaacataaccaggttgagctcgggtcctttccggaccatacggtgcgagaaacgatgtccgacctgccggaagtgcggaa

SEQ ID NO: 336 - DNA, 540 bp, Homo sapien
  misc_feature (1)...(540): n = A,T,C or G
aggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgaaaaaggatttggacgtcagaagtatgtcagaaaaacgcaccaaagcaattttcanatgccagtcaattggatttcgtt

SEQ ID NO: 337 - DNA, 422 bp, Homo sapien
  misc_feature (1)...(422): n = A,T,C or G
gcagcaggaacagttacagcagcagcagcaacagcagctgttgcaacagcagcaggaacaattgcagcagcaacaactgcagcctcctcccctggagcccgaggaggaggaagaggtggagctggagctcatgccggtggacctggggtcagagcaggagctggagcagcagcggcaggagttggagcggcagcaggagctggaacggcagcaggagcagcggcagctgcagctcaaactgcaggaggagctgcagcagctggagcaacagctggagcagcagcagcagcagctggagcagcaggaggtgcagctggagctgaccccggtggagctaggcgcccagcagcaggaggtgcagctggagctgacccccgtgcagccggagctgcagctggaactggtgccancccagggggcgg

SEQ ID NO: 338 - DNA, 601 bp, Homo sapien
  misc_feature (1)...(601): n = A,T,C or G
catcttacgaacgctctatgatgtcttatgagcggtctatgatgtcccctatggctgaacgctctatgatgtcagcctacgagcgctctatgatgtcagcctacgagcgctctatgatgtcccctatggctgagcgctctatgatgtcagcttatgaacgctccatgatgtcagcttatgaacgctccatgatgtccccaatggctgatcgatctatgatgtccatgggtgctgaccggtctatgatgtcgtcatactctgctgctgaccggtctatgatgtcatcgtactctgcagctgaccgatctatgatgtcatcttatactgctgatcgttcaatgatgtctatggctgctgattcttacaccgattcttacactgacacatatacagaggcatatatggtgccacctttgcctcctgaagagcccccaacaatgccaccgttgccacctgaggagccaccaatgacaccaccattgcctnctgaggaaccacccagagggtccagcattgcccacttgagcagtcagcattaaccagcttgaaaatacttggccctacananggtgccatcattaccatctgaagagctgtatcg

SEQ ID NO: 339 - DNA, 440 bp, Homo sapien
  misc_feature (1)...(440): n = A,T,C or G
agagggaggaggcccaactggtgatgctgctgctgctgctgctgccgccgccgccgcctctattgctgatactctagtggggctggaagggtggttcctattcgcaccatcgccaaccagagacagagggaaaaaaaaaaccggcagccactgctgatgttgggttcggaggctgcatccgactcggtcacaaggaaaatggattcagtttgcatctctccctcctttaaacagcttctccgggtctcagcatggtatcaaagcttgaaagagagaagactcaagaagcgaagaggattcgtgagctggagcagcgcaagcacacggtgctggtgacagaactcaaagccaagctccatgaggagaagatgaaggagctgcaggctgtgagggagaaccttatcaagcagcacgacaggaaatgtcaangacggtgaagg

SEQ ID NO: 340 - DNA, 450 bp, Homo sapien
  misc_feature (1)...(450): n = A,T,C or G
gatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaanncctttcac

SEQ ID NO: 341 - DNA, 451 bp, Homo sapien
aacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaag

SEQ ID NO: 342 - DNA, 498 bp, Homo sapien
  misc_feature (1)...(498): n = A,T,C or G
ctcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtgggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcagggttctggtgatggcncacaagaagtatntaaacctcttccttcaaaaaggg

SEQ ID NO: 343 - DNA, 491 bp, Homo sapien
ccgacccctactcggcggcgcaactccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttccctgcccttccgggtgtggcaaagtcttcgcgcgctccgagaacctcaagatccacaaaaggaccacacaggggagaagccgtccagtggagttga

SEQ ID NO: 344 - DNA, 412 bp, Homo sapien
  misc_feature (1)...(412): n = A,T,C or G
gtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcanacaaccgatcccgtgggtaccgtggtggctctgccgggggccggggcttcttccgtgggggcccgangacggggcccgtgggttctctaaaagaagagggga

SEQ ID NO: 345 - DNA, 498 bp, Homo sapien
aactagtctcgggccatcctttctgcgcacccggtgtcgctgggctgcaccccgggcggggacgtccgccgggcacgggagggggccaagatgccgatcaataaatcagagaagccagaaagctgcgataatgtgaaggttgttgttaggtgccggcccctcaatgagagagagaaatcaatgtgctacaaacaggctgtcagtgtggatgagatgaggggaactatcactgtacataagactgattcttccaatgaacctccaaagacatttacttttgatactgtttttggaccagagagtaaacaacttgatgtttataacttaactgcaagacctattattgattctgtacttgaaggctacaatgggactatttttgcatatggacaaaccggaacaggcaaaacttttaccatggaaaggtgtcgagctattcctgaacttagaggaataattccccaatttctttgctcacaatatttgggccatatttgc

SEQ ID NO: 346 - DNA, 427 bp, Homo sapien
  misc_feature (1)...(427): n = A,T,C or G
agatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcanntgtagctacctcccaaagagcgccccacgtagagaccttatccagggatcaaaattttggatgaaaaaggggaaagcc

SEQ ID NO: 347 - DNA, 280 bp, Homo sapien
cacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaaccc

SEQ ID NO: 348 - DNA, 411 bp, Homo sapien
caactatgatgtgcctgaaaaatgggcacgattctatactgcagaagtagttcttgcattggatgcaatccattccatgggttttattcacagagatgtgaagcctgataacatgctgctggataaatctggacatttgaagttagcagattttggtacttgtatgaagatgaataaggaaggcatggtacgatgtgatacagcggttggaacacctgattatatttcccctgaagtattaaaatcccaaggtggtgatggttattatggaagagaatgtgactggtggtcggttggggtatttttatacgaaatgcttgtaggtgatacacctttttatgcagattctttggttggaacttacagtaaaattatgaaccattaaaaattcacttacctttcctgatgata

SEQ ID NO: 349 - DNA, 408 bp, Homo sapien
gatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaaactgacttctgaggaagaagaaaa

SEQ ID NO: 350 - DNA, 409 bp, Homo sapien
ggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacaggtgggg

SEQ ID NO: 351 - DNA, 226 bp, Homo sapien
aatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggtt

SEQ ID NO: 352 - DNA, 410 bp, Homo sapien
gcggaggggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaaggtccaagacaactttgacaagattgaattcaataggatgtgttggaccctctgtgtcaaaaaaaacctcacaaagaatcccctgctcattacagaagaagatgcatttaaaatatggg

SEQ ID NO: 353 - DNA, 380 bp, Homo sapien
  misc_feature (1)...(380): n = A,T,C or G
gagtttatttagaaagtatcatagtgtaaacaaacaaattgtaccactttgattttcttggaatacaagactcgtgatgcaaagctgaagttgtgtgtacaagactcttgacagttgtgcttctctaggaggntgggtttttttaaaaaaagaattatctgngaaccatacgtgattaataaagatttcctttaaggcanaggctggtcnagatgctgctgttatcttctgcctcagacagacagtataagnggtcttgtttctaagattcctaccaccagttactttgggccaagtatccacatccccttgcgtatgggaggngggtgaanagtgttggatgcaaagnggttattatgggaagnagctcnatggtaaaa

SEQ ID NO: 354 - DNA, 379 bp, Homo sapien
  misc_feature (1)...(379): n = A,T,C or G
caacacatctttattaaacacctgaagttactgggaggaggccatgatgctggacacactgtcaaagtcaatcttctccacaatgttcttgggtttaatgctctcttcttggctacagangaanatctgccccgactngtcggcactccagccgtatttgctcatccacacctttagctggctgtccgacaganccccgagcatntcggccagcagccancggncaatgtgctggtaagtgatacccacaacatggcagataaactttcggacanagtcttcaaagccagttataccttccaagaggtccatgttttcatccagggcttgccanaagcctggaaatggcaggtctccaacaggtcccccaggtacaaaa

SEQ ID NO: 355 - DNA, 499 bp, Homo sapien
  misc_feature (1)...(499): n = A,T,C or G
gtccagagctgctggtgctcccgttccccagaccctacccctatccccagtggagccggagtgcgggcgcgccccaccaccgccctcaccatggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgcgagccttagaagagaatgaaatatctgagcactgntttgatttgatttttgcttttgatgaaaatgtcgcactgggatacccgggangaatgttaacttggcacagatcanaacctttcacagaaaa

SEQ ID NO: 356 - DNA, 511 bp, Homo sapien
  misc_feature (1)...(511): n = A,T,C or G
gggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttantttaaaagttgtaggtgattaaaataatttgaaggcgatcttttaaaaagagattaaacccgaaggtgattaaaagaccttgaaatccatgacgccagggagaattgccgtcatttaaagcctagttaac

SEQ ID NO: 357 - DNA, 511 bp, Homo sapien
  misc_feature (1)...(511): n = A,T,C or G
gatacttcacatttccctagggacgggagcccgaggggtccgttcggccctcttcctctcgctgggccgacaccccgctgtaggaccgtaacccttagtcccaatgcctccgtaagcggagttgagtgggtgcctgtggttggagctgtggaggtgtccccggtggcgagcgcggccagaactgcggtcacttaagttttccgtgtgcgggttgcaaggagcgtgcgtgcgtctggtataatttggcttcctgagattctgcttacaagaaaggagtgggaaatacccttggaaagaaaactaaaacagtaagaaaaccaaaacttatttttacatggntgtcagcacatttaccgatatggacacttttcccaataatttcctcctggtggagacagtggattgacaggttctcagtcggaattccagaaaaatgttaattgatgaaaagggtacnatgtgagcatcataaagntaattattaanacactgaaggctgaacacacaaggg

SEQ ID NO: 358 - DNA, 401 bp, Homo sapien
  misc_feature (1)...(401): n = A,T,C or G
acggatgaagatgatgaccttcaagaaaatgaagacaataaacaacataaagaaagcttgaaaagagtgacctttgctttaccagatgatgcggaaactgaagatacaggtgttttaaatgtaaagaaaaattctgatgaagttaaatcctcctttgaaaaaagacaggaaaagatgaatgaaaaaattgcatctttagaaaaagagttgttagaaaaaaagcccgtggcagcttcagggggaagtgacagcacagaagaggccagagaacacctcctggaggagaccctacctttgccatctgcccgatggccctgtgattacagaggaacccccttcactggagatttctttaacngangatagagatcngnttgggatatgtntccttaagaaaacct

SEQ ID NO: 359 - DNA, 511 bp, Homo sapien
  misc_feature (1)...(511): n = A,T,C or G
gcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgcccgcgcacttcgtcatgttcttcgcgccctggtgtggacacttgccagcggcttgcagccgantttggaatgaccttgggangaacaaatacaacagcatggaaagaatgccaaaagtctatgtggnttaaagtggacttgcacnggccacttcgactngtgctcccccaaggggngggaagatacccaccttaaaacttttcaaccaagccaaaaactttgaaaaccaggtctcggattcaaaatggaaaactgatgttcaacctgaacaagaa

SEQ ID NO: 360 - DNA, 511 bp, Homo sapien
  misc_feature (1)...(511): n = A,T,C or G
tactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtcccgactctcaagatcatgagtggtgtgtcnagccnggggatgatggcggatctgntttttgagcancagatggtagaaaaagctggttccctgtttggatgagcttgatcagtatcccatacccattctttccagaggattcttggagccggaaagaanggagtcttcttggtgggataaaaagtgaaaaagaactttctcttcaanaaggatagggggatgtgctttgtaaaatcantttttcagggngganaatgccnnaaccgttttaaagaaaaacatnttgggnaagtttttgtgggccaacattacccggtcttgtaaacctaccttcaaagaacctttttgcccagggttaa

SEQ ID NO: 361 - DNA, 411 bp, Homo sapien
  misc_feature (1)...(411): n = A,T,C or G
gctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaagcacaacttgcggaggctgcagcttaacgcggaccctgagaagcctggcgcttncngctggaacttcttggcgcgggacctggggcggtaatttgagtggccctgagtcatttctacaccatccaggcccaccacacgactaagctcacaagaaggctgaactnnctgattctnaacctagaantacgtgcatctatcagtgccngaagaaatgacaacataccactggcaactctg

SEQ ID NO: 362 - DNA, 511 bp, Homo sapien
  misc_feature (1)...(511): n = A,T,C or G
cgggggaccgggctgccttggcccctcagcgctcgcgtcttttccggcagttggaacgcttcctgttgtcctcacccgtaaccgcctgttgccccctgtctcagagtccctcacgcgtcccctcccgtctttggctcgttggctgccgccgccggggcttcgccagccttcaagtcgagactactggccgaaggggcgtctgcggctctccgccgtccccagccctgcctctccctgggctctgccatggcaatgacaggctcaacaccttgctcatccatgagtaaccacacaaaggaaagggtgacaatgaccaaaagtgacactggagaatttttatagcaaccttatcgctcacatgaagaacgagaaatgagacaaaagaagttagaaaaaggggatggaagaagaaggcctaaaaaaatgaaggagaaaaccaacttccgaagatcaaccacattgcttcggaaanggaaacaaaantttctttcgtttgaaanaaaaacaaana

SEQ ID NO: 363 - DNA, 401 bp, Homo sapien
caggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcaga

SEQ ID NO: 364 - DNA, 401 bp, Homo sapien
agtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgt

SEQ ID NO: 365 - DNA, 361 bp, Homo sapien
atctggagttgcacaaatagttctttagaacataaaactaaatggatttatacataacagttacattcagcatttaagagaggcagtacaaaaatgtgttctgcttttatctgatataaattgcatgtaataccatgatttaaacaatatcagttatattaactaatgccatgagatatatcttactcagaacgtctgatgtttcccataatagacagaaaaaatgcagttgtatgagcaactgagtttcttttcatcttcaaattcatttgtgatggtgggaagatctaaggacaatccttccattgaagaagtaggaaaaacagttcagcactgttctgaactcatcaaaaatgaaatt

SEQ ID NO: 366 - DNA, 401 bp, Homo sapien
cgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggc

SEQ ID NO: 367 - DNA, 401 bp, Homo sapien
catggagtcgggcaagatggcgcctcccaagaacgctccgagagatgccttggtgatggcacagatcctgaaggatatgggaatcacagagtatgaaccaagggttataaatcaaatgttggaatttgctttccgttatgtgactacaattctggatgatgcaaaaatttattcgagccatgctaagaaacctaatgttgatgcagatgatgtgagactggcaatccagtgtcgtgctgaccaatcttttacctctcctcccccaagagattttttactggatatcgcaaggcagaaaaatcaaacccctttgccactgattaagccatatgcaggacctagactgccacctgatagatactgcttaacagctccaaactataggctgaagtccttaatta

SEQ ID NO: 368 - DNA, 401 bp, Homo sapien
cggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccctgccccctcccctggatgcc

SEQ ID NO: 369 - DNA, 174 bp, Homo sapien
  misc_feature (1)...(174): n = A,T,C or G
gcgagnngggcgccaagcgcggggccggagcggccttcccggagtcctttgcgcggcacctggcgacaaaatggctgcccgagggagacgggcggagcctcagggccgggaggctccgggccccgcgggcggtggcggtggcgggagccgttgggctgagtcgggatcggggac

SEQ ID NO: 370 - DNA, 375 bp, Homo sapien
  misc_feature (1)...(375): n = A,T,C or G
tgcttttccaactttatttagaaaaacaaatccaggtcccagtgccccctgtaccctccccgaccccagccataatttaaataacttanagacagagttggagggaggggacagganaggttggggtcacggtggaaggaggaaganagcccactacagccgccgcagcgcccgcttcttgtccgtctttttcttggccgccagcttcttatcgcgctcgccagcatgcttnttggccatgggaccctcagcccctcccgggccccctggggccccagggtcggtggaggaagcttcagtgccactggccagggcccgaccggcttcggccctgccgctgggcccgccggcgcccccgtggatctctgtgagcag

SEQ ID NO: 371 - DNA, 375 bp, Homo sapien
  misc_feature (1)...(375): n = A,T,C or G
taaattctaaaaaatattttaatacttgaaaacttctaaaacaaaaggtaaggtaacatgttctttcaaaagtgaatttcacatgcaaaccattaattatatttattttactgngagataaaagcaaaacataacattcggagaaagagaccagtaactgacctatttattttatattatattaatgngaatcctcattagaaatgtgataacgttattgcacaaacaaaaccgtgggcagaaacatcccagcaatgcaggggcgcccataccgggttacaagggatgtccagcatgtgtttccctggaacactcanagtctgcacttttcctgcaaatgggaccatgtctgattatttattatgaaagaacact

SEQ ID NO: 372 - DNA, 164 bp, Homo sapien
  misc_feature (1)...(164): n = A,T,C or G
cgctctgtntcctcaacctctacctggcggaggttatatgtaaagtcagatgtgccactgaacttgacagacacaaaattctactgcatttgggctttataatggcaagcctgctctttttagtggtgaacttgacttgcgcaatgctagttcatggagatgtc

SEQ ID NO: 373 - DNA, 401 bp, Homo sapien
gcgctgttcgcctttgcctacctgcagctgtggcggctgctcctgtaccgcgagcggcggctgagttaccagagcctctgcctcttcctctgtctcctgtgggcagcgctcaggaccaccctcttctccgccgccttctcgctcagcggctccctgcccttgctccggccgcccgctcacctgcacttcttcccccactggctgctctactgcttcccctcctgtctccagttctccacgctctgtctcctcaacctctacctggcggaggttatatgtaaagtcagatgtgccactgaacttgacagacacaaaattctactgcatttgggctttataatggcaagcctgctctttttagtggtgaacttgacttgcgcaatgctagttcatggagatgt

SEQ ID NO: 374 - DNA, 401 bp, Homo sapien
ggaatgataccattcagattgatttggagactggcaagattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcaggattaatagcaaaaaaaa

SEQ ID NO: 375 - DNA, 401 bp, Homo sapien
gagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggact

SEQ ID NO: 376 - DNA, 284 bp, Homo sapien
  misc_feature (1)...(284): n = A,T,C or G
ggaacaaggtcgtgaaaaaaaaggtcttggtgaggtgccgccatttcatctgtcctcattctctgcgcctttcgcagagcttccancagctggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtantaagacaccaactgcttaaaacat

SEQ ID NO: 377 - DNA, 401 bp, Homo sapien
atttatgttattgcactctcggtgtgatttatcgtatgtatctgataggttttatgaattgttttgagttgtaaactcctataccctttattaaaatggacctaattaagtgatttatgctttgtgcaatttcttaaatcagatctctctaggattgaagggatccataggtatctttcacttagtgtgaagcctagtagtatacttttatattcctgaagagagaccagcattaacataaagagagaagtcttaggaaaaaatatacctaagaattatttttaaaattcatactgtgaaggagaatctgcctgcctatttcctctccaaatttcagaaaataacacagagtgctatttgcctgaactttaatgagcttgactttgttatgattcagggag

SEQ ID NO: 378 - DNA, 401 bp, Homo sapien
ccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgtt

SEQ ID NO: 379 - DNA, 401 bp, Homo sapien
tcagatatcaggtggcttcttcaaatgatttttaagtatctcgatgatgatgaagaacaaagacatcaatcaggattcaggaagacagcttttgcggaaaatgcttaaagggaagcatcaaggattggtgttgatatttgaaagtttaagagtggtatacttttattcagtcaacacatgacaaatgtaaaaggcactcatttgttgttcctggaagaagcctggcagcattccattcagacatctgccctttcatcgtcccactttttacttattgcagtcctttcagtctgaatatttcctcctgacgcatcttctgccgtccgaaatgactccctgctcccagatcctgtagcccttattattgacacctttcatttagaaatttagcacatgtcaca

SEQ ID NO: 380 - DNA, 401 bp, Homo sapien
cctgactctctgaggctcattttgcagttgttgaaattgtccccgcagttttcaatcatgtctgaaccaatcagagtccttgtgactggagcagctggtcaaattgcatattcactgctgtacagtattggaaatggatctgtctttggtaaagatcagcctataattcttgtgctgttggatatcacccccatgatgggtgtcctggacggtgtcctaatggaactgcaagactgtgcccttcccctcctgaaagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagc

SEQ ID NO: 381 - DNA, 401 bp, Homo sapien
  misc_feature (1)...(401): n = A,T,C or G
ggggcttcgctggcagtctgaacggcaagcttgagcaacgcggtaaaaatattgcttcggtgggtgacgcggtacagctgtccaagggcnttngtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttc

SEQ ID NO: 382 - DNA, 491 bp, Homo sapien
gagcagcccccggcggctgaaagccggggcagaagtgctggtctcggtcgggattccgggcttggtcccaccgaggcggcgactgcggtaggagggaagaggttttggacgcgctggcctcccgccgctgtgcattgcagcattatttcagttcaaaatgaactatatgcctggcaccgccagcctcatcgaggacattgacaaaaagcacttggttctgcttcgagatggaaggacacttataggctttttaagaagcattgatcaatttgcaaacttagtgctacatcagactgtggagcgtattcatgtgggcaaaaaatacggtgatattcctcgagggatttttgtggtcagaggagaaaatgtggtcctactaggagaaatagacttggaaaaggagagtgacacacccctccagcaagtatccattgaagaaattctagaagaacaaagggtggaacagcagaccaagctggaagcagagaagt

SEQ ID NO: 383 - DNA, 491 bp, Homo sapien
gagtccatctcagcgcctggaaaatgcagtgaaaaaacctgaagataaaaaggaagttttcagacccctcaagcctgctggcgaagtggatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagagtacagttgaccaaaagcgtgccagccatcatgagagcaatggctttgccggtcgcattcacctcttgccagatctcttacagcaaagccattcctcctccactt

SEQ ID NO: 384 - DNA, 491 bp, Homo sapien
gagcctaatctcaggtggtccacccgagaccccttgagcaccaaccctagtcccccgcgcggccccttattcgctccgacaaggtacaaaaaggctctggacggcggcgtggtaggaggacgggagcgggggcgggaagttccctgaaggagcgagacagggagggacagggcagaggaggagaggaaggcgatgcgacggacaggcgcacccgctcaggctgactctcgggggcgaggtcgagccaggggcggctgccctgggggcgaggcgacgctgtctcaacctccacctcgcggcggaacccgaggacaggagcctcagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatat

SEQ ID NO: 385 - DNA, 483 bp, Homo sapien
agccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacct

SEQ ID NO: 386 - DNA, 491 bp, Homo sapien
aggtggaaggaaaaaacataaatgaagttaatgcacttcttttcctagcccaaaagtcactgtgattatatttttttaatgaagtttagaaaaaaagctgttgtcttctcaattgtaaaattagtttcaaaatgctgcttctcttatcattagtctagtaattgttgaacttttctgcaaactgcattttacaaaattgaaacttggaagctgtattaacttttatagttaaacattgtattaaataaactatactataataaacagtttggttttgtattttttaaattgtattatccagccttttaaaaattaaaagctaaataatgaaaataaaccaattaaaacatacttttactctcagatatacaggtatttacattatgaaaaaactgaacaaagttttaacaatactgagctttaagaatttagccagcagggaaaatttccaggtttgagaatgttctaatgtaaatatttaatcataatac

SEQ ID NO: 387 - DNA, 491 bp, Homo sapien
ccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctag

SEQ ID NO: 388 - DNA, 491 bp, Homo sapien
gagactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttgaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcacagtcgcatcataatcctctctcaaggac

SEQ ID NO: 389 - DNA, 511 bp, Homo sapien
  misc_feature (1)...(511): n = A,T,C or G
tactgatatctctttaatactttcatcattcaagtttgttcanaacattacaagaggcatgaaagaaaaaataattccatttttaaaactctgtctgtccaaagtataacatatgaaaccatgccattatctnttaggaaacaaaagcattcaaaattaatttggtattaaagttcaagattcanactaacctcaaagtacggcatgtgcagtgtttaagtgcaanaagtattttcattccaattattttacananatgctggagtgacgtgtgcaatttgaaatattcaaatcctttaaggnttctgaactaagtgtttaaatgaaaactgaaatgctgcatagtttcagtggctttcaatttcctgtttgatctcagaaatatatggatgatctttgccgtgagctacttccatgattgcaatggccttcttcagggctttctcccctgcggctttgtgttccaggcccatgtagagtctccctagcttcaaccacatggaggccacgt

SEQ ID NO: 390 - DNA, 1984 bp, Homo sapien
cctggggttagaggctggggtgggtggggggtaagggggcagtccttctccccttcgacggcggctccgagtccagccccttccttcccgcgctcgctcgcccggcccccagccccctcatgagggtgtccgtgccgggtccggcggccgctgccgcccccgcagccggccgcgagccctccacgcccggcgggggcagcggaggcggaggcgccgtcgctgcagcctcaggcgccgcggtgccgggctccgtgcagttggcgctgagcgtcctgcacgccctgctctacgccgcgctgttcgcctttgcctacctgcagctgtggcggctgctcctgtaccgcgagcggcggctgagttaccagagcctctgcctcttcctctgtctcctgtgggcagcgctcaggaccaccctcttctccgccgccttctcgctcagcggctccctgcccttgctccggccgcccgctcacctgcacttcttcccccactggctgctctactgcttcccctcctgtctccagttctccacgctctgtctcctcaacctctacctggcggaggttatatgtaaagtcagatgtgccactgaacttgacagacacaaaattctactgcatttgggctttataatggcaagcctgctctttttagtggtgaacttgacttgcgcaatgctagttcatggagatgtcccagaaaatcagttgaagtggactgtgtttgttcgagcattaattaatgatagcctgtttattctttgtgccatctctttagtgtgttacatatgcaaaattacaaaaatgtcatcagctaatgtctacctcgaatcaaagggtatgtctctgtgccagactgtcatcgtgggctctgtagtcattcttctgtactcttccagagcttgttataatttggtggtggtcaccatatctcaggatacattagaaagtccatttaattatggctgggataatctttcagataaggctcatgtagaagacataagtggagaagagtatatagtatttggaatggtcctctttctgtgggaacatgtgccagcatggtcggtggtactgtttttccgggcacagagattaaaccagaatttggcacctgctggcatgataaatagtcacagttatagttccagagcttactttttcgacaatccaagacgatatgatagtgatgatgacctgccaagactgggaagttcaagagaaggaagtttaccaaattcgcaaagtttgggctggtatggcaccatgactgggtgtggcagcagcagttacacagtcactccccacctgaatggacctatgacagatactgctcctttgctctttacttgtagtaatttagatttgaacaatcatcatagcttatatgtgacaccacaaaactgacagcatcaccaagtcatgattcttgagttgtttttcataaatgtgtatattcaatgtgtttaaattccatctacataaacattccattatctgttgcaactgaaaacaaaatctggaagtgtggctgtgtttggtaaataacacagctattatttttgacctcttcatagtaaaatgaagtaaaatggaaagtttggagtaggagaaaagagagattagatcttaaggcacttgatggcctccaaaaatcctgactttggaacatcaaatgcatatgtgcacttttatctttgttctgagtcactgcagtccccaaagtcatatgccaatgttcacactgaaatactgtattgtacaccaaactggaaggcaattttcctatgaaaatcaaagccggtatattcattggtatgctctatacagatatcttaataaaaattttatagtgtgaacagtgcacagagttaaggcataaaaatgtatcattctttataaaaatctactgaaaatgtgtaatcattgaagacagttcttttaagcatgattttaaaatagcaactgaaattcaatcattt

SEQ ID NO: 391 - protein, 429 aa, Homo sapien [sequence omitted]

SEQ ID NO: 392 - DNA, 1584 bp, Homo sapiens
ggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaaaaaaaaaaaaaaaaaactcgag

SEQ ID NO: 393 - protein, 191 aa, Homo sapiens
MGKSCKVVVCGQASVGKTSILEQLLYGNHVVGSEMIETQEDIYVGSIETDRGVREQVRFYDTRGLRDGAELPRHCFSCTDGYVLVYSTDSRESFQRVELLKKEIDKSKDKKEVTIVVLGNKCDLQEQRRVDPDVAQHWAKSEKVKLWEVSVADRRSLLEPFVYLASKMTQPQSKSAFPLSRKNKGSGSLDG

SEQ ID NO: 394 - DNA, 1937 bp, Homo sapiens
ccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaactcgag

SEQ ID NO: 395 - DNA, 1675 bp, Homo sapiens
gcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcaaaaaaaaaaaaaaaaa

SEQ ID NO: 396 - protein, 559 aa, Homo sapiens
GSPSSGYPALHRVAMMGHRPVLVLSQNTKRESGRKVQSGNINAAKTIADIIRTCLGPKSMMKMLLDPMGGIVMTNDGNAILREIQVQHPAAKSMIEISRTQDEEVGDGTTSVIILAGEMLSVAEHFLEQQMHPTVVISAYRKALDDMISTLKKISIPVDISDSDMMLNIINSSITTKAISRWSSLACNIALDAVKMVQFEENGRKEIDIKKYARVEKIPGGIIEDSCVLRGVMINKDVTHPRMRRYIKNPRIVLLDSSLEYKKGESQTDIEITREEDFTRILQMEEEYIQQLCEDIIQLKPDVVITEKGISDLAQHYLMRANITAIRRVRKTDNNRIARACGARIVSRPEELREDDVGTGAGLLEIKKIGDEYFTFITDCKDPKACTILLRGASKEILSEVERNLQDAMQVCRNVLLDPQLVPGGGASEMAVAHALTEKSKAMTGVEQWPYRAVAQALEVIPRTLIQNCGASTIRLLTSLRAKHTQENCETWGVNGETGTLVDMKELGIWEPLAVKLQTYKTAVETAVLLLRIDDIVSGHKKKGDDQSRQGGAPDAGQE

SEQ ID NO: 397 - protein, 307 aa, Homo sapiens
RESRSRAMEEEASSPGLGCSKPHLEKLTLGITRILESSPGVTEVTIIEKPPAERHMISSWEQKNNCVMPEDVKNFYLMTNGFHMTWSVKLDEHIIPLGSMAINSISKLTQLTQSSMYSLPNAPTLADLEDDTHEASDDQPEKPHFDSRSVIFELDSCNGSGKVCLVYKSGKPALAEDTEIWFLDRALYWHFLTDTFTAYYRLLITHLGLPQWQYAFTSYGISPQAKQWFSMYKPITYNTNLLTEETDSFVNKLDPSKVFKSKNKIVIPKKKGPVQPAGGQKGPSGPSGPSTSSTSKSSSGSGNPTRK

SEQ ID NO: 398 - DNA, 416 bp, Homo sapiens
agaattcggcacgaggattgcctatctccagtgcaacaaccatcaagtgtgctgaaagtcttcagccggttgctgcagcagtggaagaaagggctacaggtccagtcttgataagcaccgccgactttgaggggcctatgcccagtgcgcccccagaagctgaaagtcctcttgcctcaaccagcaaggaggagaaggatgaatgtgctctcatttccactagcatagcagaagaatgtgaggcttctgtttccggtgtagttgttgaaagtgaaaatgagcgagctggcacagtcatggaagaaaaagacgggagtggcatcatctctacgagctcggtggaagactgtgagggcccagtgtccagtgctgtccctcaagaggaaggcgacccctcagtcacaccagcggaagag

SEQ ID NO: 399 - DNA, 259 bp, Homo sapiens
  misc_feature (1)...(259): n = A,T,C or G
caaagaattcggcacgagggggcgacctgcattcggacgtcaccgaggccatgctgtacgaaaagttcagccccgcggggcctgtgctgtncatccgggtctgccgngatatgatcacccgccgctccctgggctatgcctacgncaacttccancaaccggccgacgctgatcgggctttggacaccatgaactttgatgtgattnagggaaanccaatccttatcntgtnnnaatcataggnatccttctttgacaa

SEQ ID NO: 400 - DNA, 410 bp, Homo sapiens
ggcacgaggggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgcccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaat

SEQ ID NO: 401 - DNA, 433 bp, Homo sapiens
  misc_feature (1)...(433): n = A,T,C or G
ggnacgaggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggccgtgaagtcgtcagaacacatcaacgagggggagacggccatgctggtctgcaagtcagagtccgtgccacctgtcactgactgggcctggtac

SEQ ID NO: 402 - DNA, 434 bp, Homo sapiens
ggcacgaggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaaggatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatgg

SEQ ID NO: 403 - DNA, 435 bp, Homo sapiens
ggcacgaggaactgctgttgccattcaaaccattgaggagcatcctgcatcttttgactggagctcttttaagccaatgggatttgaagtatcatttctgaagtttcttgaggagtctgcagtgaagcagaagaaaaatactgacaaagaccatccgaatactggaaacaaaaaaggatcccattcaaattcaagaaaaaatattgataagactgctgtgactagtggaaatcatgtatgtccttgtaaagaaagcgaaacgtttgtacagtttgccaatccatcacagcttcagtgcagtgataatgtaaaaattgttttagacaagaatcttaaagattgcactgagcttgtcttaaagcaacttcaggaaatgaaacctaccgtcagtctgaaaaaacttgaagtacattcaaatgatccagatatgtctgt

SEQ ID NO: 404 - DNA, 416 bp, Homo sapiens
aaagaattcggcacgaggcgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgctt

SEQ ID NO: 405 - DNA, 435 bp, Homo sapiens
ggcacgagggctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacgga

SEQ ID NO: 406 - DNA, 424 bp, Homo sapiens
  misc_feature (1)...(424): n = A,T,C or G
gcccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgnaaatttaactgntagtccaaag

SEQ ID NO: 407 - DNA, 423 bp, Homo sapiens
gctcctaccggcgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaagtgttgagg

SEQ ID NO: 408 - DNA, 424 bp, Homo sapiens
gaaaaaaaatagcttactgaattctataagatgtgtgggaatctcacctatcaaaaataggtaaaaagagcctccaaacctgctttgattttattcacctattcttttaggccaggaactaatttacctctcactatcctgttccctcttgctatcttgtggagtctctaaagacaaaggtataaagagcttttggtaggtgaattaataatcaactagatggcatttccaaatgggattgcacatactgtggggcaagtcccaagtgaacttcaaagtgagacgtttatttgagtaatccttccagattaacaataatcataatagcagttaccacttcctgagtactttctatatgccatgtattgagcttgctcacttctttatgtggattcttatttaatcttaataccaagatgaggtg

SEQ ID NO: 409 - DNA, 398 bp, Homo sapiens
  misc_feature (1)...(398): n = A,T,C or G
gctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccgggctgngtttgtagacttggaacccacagtnattgatgaagntcgnactggcacctacccgcaggtcttncaccctgancanntcatnacaggcaaggaagatgctgncaaataactatgcccga

SEQ ID NO: 410 - DNA, 423 bp, Homo sapiens
gccccaccccacctgcccgctgcggctctccgcgggagatctcaccgttctggagacagggctcgctcgctctcacgctgcccggccagcccgcttctctgcccggagccatgaatctcagtagcgccagtagcacggaggaaaaggcagtgacgaccgtgctctggggctgcgagctcagtcaggagaggcggacttggaccttcagaccccagctggaggggaagcagagctgcaggctgttgcttcatacgatttgcttgggggagaaagccaaagaggagatgcatcgcgtggagatcctgcccccagcaaaccaggaggacaagaagatgcagccggtcaccattgcctcactccaggcctcagtcctccccatggtctccatggtaggagtgcagctttctcccccagttactttcc

SEQ ID NO: 411 - DNA, 424 bp, Homo sapiens
  misc_feature (1)...(424): n = A,T,C or G
gcggaggcgactagcggcggcgggagcggcgccgagaggccgtgcgggacgcgggcgccaggaccggccgaacgcagaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaangccagaaccagacataagttcagaggaatctgtctccactgtagaagaacaaga

SEQ ID NO: 412 - DNA, 430 bp, Homo sapiens
ggcacgaggggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgt

SEQ ID NO: 413 - DNA, 429 bp, Homo sapiens
ggcacgaggtcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacg

SEQ ID NO: 414 - DNA, 429 bp, Homo sapiens
ggcacgaggacgggcccggctgccggcccccgctctgccctgcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaag

SEQ ID NO: 415 - DNA, 398 bp, Homo sapiens
  misc_feature (1)...(398): n = A,T,C or G
gcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtactttgagaatcactacaagaaaaactccttgtggtgaaggttctaagacgtgggatcgtttccagatgagaattcacaagcgactcattgacttgcacagtccttctgagattgttaagcanattacttccatcantatt

SEQ ID NO: 416 - DNA, 269 bp, Homo sapiens
  misc_feature (1)...(269): n = A,T,C or G
gccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcangatcttttggcagtcctgtggnctcnctccccgnccggatcctnctgaccctganattcnnggtntnacnnnccgtncacgccttgntt

SEQ ID NO: 417 - DNA, 408 bp, Homo sapiens
ggccgggagaaccgttcgcggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccagactgtgttcctgg

SEQ ID NO: 418 - DNA, 402 bp, Homo sapiens
gagccgggcagccgcttcccgcccccgagcaggagccggtgcgagcggagcagagccgaggtcgggccgcgagcggagccggctgagcgggcgccgagctcccgccatggcccggaacacgctgtcctcgcgcttccgccgggtggacatcgacgaatttgacgagaacaaatttgtggacgagcaggaggaggcggcggcggcggcggcggagccaggcccggacccgagcgaggtggacgggctcctgcggcaaggggacatgcttcgggcattccatgcagccttgcggaactctcccgtcaacaccaagaatcaagctgtgaaggagcgagcccagggcgtggtgctgaaagtgctcacaaacttcaagagcagtgagattgagcaggctgtgcagtc

SEQ ID NO: 419 - DNA, 406 bp, Homo sapiens
gcccgggctagcggcctgggttgggctttgtagctgctccgcaggcccagcccgggccgcgctcgcagagtcctaggcggtgcgcggcctcctgcctcctccctcctcggcggtcgcggcccgccggcctccgcggtgcctgccttcgctctcaggttgaggagctcaagcttgggaaaatggtgtgcattccttgtatcgtcattccagttctgctctggatctacaaaaaattcctggagccatatatataccctctggtttcccccttcgttaagtcgtatatggcctaaaaaaagaattcaaagaaatccaatgatccaaacaaaagggcaaaagtaaaaacttttaaaggggtgcaagaacattgaaatgggaattacccaaccaaaaaagggaacccaac

SEQ ID NO: 420 - DNA, 371 bp, Homo sapiens
cagccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttttt

SEQ ID NO: 421 - protein, 51 aa, Homo sapiens [sequence omitted]

SEQ ID NO: 422 - DNA, 12308 bp, Homo sapiens
ttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacaggtgaggcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttt

SEQ ID NO: 423 - DNA, 596 bp, Homo sapiens
ggccggtgaaggaccgcgaggccttccagaggctcaacttcctgtaccaggtgagtctgcgacaagggccccacggggacggtgctcggcgtcccagagtgactgctcccctcccgcaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccaccgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcaaaaaaaaaaaaaaaaaactcgag

SEQ ID NO: 424 - DNA, 1549 bp, Homo sapiens
tgtgagaccgccaagatggtggtgggcgcgttccctatggcgaagctgctatacttgggcatccggcaggtcagcaagccgcttgccaaccgtattaaggaggccgcccgccgaagcgagttcttcaagacctatatctgcctcccgccggctcaactgtatcactgggtggagatgcggaccaagatgcgcatcatgggcttccggggcacggtcatcaagccgctgaacgaggaggcggcagccgagctgggcgcagagctgctgggcgaagccaccatcttcatcgtgggcggcggctgcctagtgctggagtactggcgccaccaggcgcagcagcgccacaaggaggaggagcagcgtgctgcctggaacgcgctgcgggacgaggtgggccacctggcgctggcgctggaagcgctgcaggcgcaggtgcaggcggcgccgccacagggcgccctggaggaactgcgcacagagctgcaagaggtgcgcgcccagctctgcaatcccggccggtccgcttcccacgcagtgcctgcgtccaagaaataggagcttgctggatggaacctgaatttggacatggcctatgtacctaacgtggccttcttcccgcaccacccttgcctgcgctggcccagtggaaaccaccaggatcttgatgcaacttggcatttggttacccctgctgataagagcagccattacctgccactgggaccagcaggtgaagcgttgcaacatagccccctccatcatccttcacctcctatcccccactccaaaccaggacgacctgcaaggtcccagccagcaggacaccgtgggcactctggcaaatgaaaaaatggaacctggtcttgagctgaatcaatgtgttattgttacccccacccccggtttacctgatcagtgttaacctttactgggacactcatctgttacactggaacaccttcttctttttgtcaatcggcacagaccactgtaaggaaatgcagtgtgttgcagtggccttttctccccctcaccttctaaggtcagctctagctgagcatcagtgctctcttaaggaggaaaaaaacggtgcggctgggagcggtggctcacgcctgtaatcctagcaccttgggaggccgaggcgggcggatcacttgaggtcaggagttccagaccagcctggccaacatggtgaaactccgtctctactaaaaatacaaaaattagccgggtgtggtggggtgcgcttgtaatcccagctactcgggaggctgaggcaggagaattgcttgaacccatgaggtggaggttgcggtgagccaagatggcaccattgcaccctagcctgggcaacagagcaagacaccgtcttaaaaccaaaagttaaccgggcgtggtggtgggtgcctgtaatcctagctacttgggaggctgaggcaggagaattgcttgaacttgggaggtggaggccaagattgtaccactgtattccagcccgggtgacagagcaagactgtgtctcaaaaaaaaaaaaaaaaaactcgag

SEQ ID NO: 425 - protein, 4019 aa, Homo sapiens
LFSSSDKFTLNQDMCVVCGSFGQGAEGRLLACSQCGQCYHPYCVSIKITKVVLSKGWRCLECTVCEACGKATDPGRLLLCDDCDISYHTYCLDPPLQTVPKGGWKCKWCVWCRHCGATSAGLRCEWQNNYTQCAPCASLSSCPVCYRNYREEDLILQCRQCDRWMHAVCQNLNTEEEVENVADIGFDCSMCRPYMPASNVPSSDCCESSLVAQIVTKVKELDPPKTYTQDGVCLTESGMTQLQSLTVTVPRRKRSKPKLKLKIINQNSVAVLQTPPDIQSEHSRDGEMDDSREGELMDCDGKSESSPEREAVDDETKGVEGTDGVKKRKRKPYRPGIGGFMVRQRSRTGQGKTKRSVIRKDSSGSISEQLPCRDDGWSEQLPDTLVDESVSVTESTEKIKKRYRKRKNKLEETFPAYLQEAFFGKDLLDTSRQSKISLDNLSEDGAQLLYKTNMNTGFLDPSLDPLLSSSSAPTKSGTHGPADDPLADISEVLNTDDDILGIISDDLAKSVDHSDIGPVTDDPSSLPQPNVNQSSRPLSEEQLDGILSPELDKMVTDGAILGKLYKIPELGGKDVEDLFTAVLSPANTQPTPLPQPPPPTQLLPIHNQDAFSRMPLMNGLIGSSPHLPHNSLPPGSGLGTFSAIAQSSYPDARDKNSAFNPMASDPNNSWTSSAPTVEGENDTMSNAQRSTLKWEKEEALGEMATVAPVLYTNINFPNLKEEFPDWTTRVKQIAKLWRKASSQERAPYVQKARDNRAALRINKVQMSNDSMKRQQQQDSIDPSSRIDSELFKDPLKQRESEHEQEWKFRQQMRQKSKQQAKIEATQKLEQVKNEQQQQQQQQFGSQHLLVQSGSDTPSSGIQSPLTPQPGNGNMSPAQSFHKELFTKQPPSTPTSTSSDDVFVKPQAPPPPPAPSRIPIQDSLSQAQTSQPPSPQVFSPGSSNSRPPSPMDPYAKMVGTPRPPPVGHSFSRRNSAAPVENCTPLSSVSRPLQMNETTANRPSPVRDLCSSSTTNNDPYAKPPDTPRPVMTDQFPKSLGLSRSPVVSEQTAKGPIAAGTSDHFTKPSPRADVFQRQRIPDSYARPLLTPAPLDSGPGPFKTPMQPPPSSQDPYGSVSQASRRLSVDPYERPALTPRPIDNFSHNQSNDPYSQPPLTPHPAVNESFAHPSRAFSQPGTISRPTSQDPYSQPPGTPRPVVDSYSQSSGTARSNTDPYSQPPGTPRPTTVDPYSQQPQTPRPSTQTDLFVTPVTNQRHSDPYAHPPGTPRPGISVPYSQPPATPRPRISEGFTRSSMTRPVLMPNQDPFLQAAQNRGPALPGPLVRPPDTCSQTPRPPGPGLSDTFSRVSPSAARDPYDQSPMTPRSQSDSFGTSQTAHDVADQPRPGSEGSFCASSNSPMHSQGQQFSGVSQLPGPVPTSGVTDTQNTVNMAQADTEKLRQRQKLREIILQQQQQKKIAGRQEKGSQDSPAVPHPGPLQHWQPENVNQAFTRPPPPYPGNIRSPVAPPLGPRYAVFPKDQRGPYPPDVASMGMRPHGFRFGFPGGSHGTMPSQERFLVPPQQIQGSGVSPQLRRSVSVDMPRPLNNSQMNNPVGLPQHFSPQSLPVQQHNILGQAYIELRHRAPDGRQRLPFSAPPGSVVEASSNLRHGNFIPRPDFPGPRHTDPMRRPPQGLPNQLPVHPDLEQVPPSQQEQGHSVHSSSMVMRTLNHPLGGEFSEAPLSTSVPSETTSDNLQITTQPSDGLEEKLDSDDPSVKELDVKDLEGVEVKDLDDEDLENLNLDTEDGKVVELDTLDNLETNDPNLDDLLRSGEFDIIAYTDPELDMGDKKSMFNEELDLPIDDKLDNQCVSVEPKKKEQENKTLVLSDKHSPQKKSTVTNEVKTEVLSPNSKVESKCETEKNDENKDNVDTPCSQASAHSDLNDGEKTSLHPCDPDLFEKRTNRETAGPSANVIQASTQLPAQDVINSCGITGSTPVLSSLLANEKSDNSDIRPSGSPPPPTLPASPSNHVSSLPPFIAPPGRVLDNAMNSNVTVVSRVNHVFSQGVQVNPGLIPGQSTVNHSLGTGKPATQTGPQTSQSGTSSMSGPQQLMIPQTLAQQNRERPLLLEEQPLLLQDLLDQERQEQQQQRQMQAMIRQRSEPFFPNIDFDAITDPIMKAKMVALKGINKVMAQNNLGMPPMVMSRFPFMGQVVTGTQNSEGQNLGPQAIPQDGSITHQISRPNPPNFGPGFVNDSQRKQYEEWLQETQQLLQMQQKYLEEQIGAHRKSKKALSAKQRTAKKAGREFPEEDAEQLKHVTEQQSMVQKQLEQIRKQQKEHAELIEDYRIKQQQQCAMAPPTMMPSVQPQPPLIPGATPPTMSQPTFPMVPQQLQHQQHTTVISGHTSPVRMPSLPGWQPNSAPAHLPLNPPRIQPPIAQLPIKTCTPAPGTVSNANPQSGPPPRVEFDDNNPFSESFQERERKERLREQQERQRIQLMQEVDRQRALQQRMEMEQHGMVGSEISSSRTSVSQIPFYSSDLPCDFMQPLGPLQQSPQHQQQMGQVLQQQNIQQGSINSPSTQTFMQTNERRQVGPPSFVPDSPSIPVGSPNFSSVKQGHGNLSGTSFQQSPVRPSFTPALPAAPPVANSSLPCGQDSTITHGHSYPGSTQSLIQLYSDIIPEEKGKKKRTRKKKRDDDAESTKAPSTPHSDITAPPTPGISETTSTPAVSTPSELPQQADQESVEPVGPSTPNMAAGQLCTELENKLPNSDFSQATPNQQTYANSEVDKLSMETPAKTEEIKLEKAETESCPGQEEPKLEEQNGSKVEGNAVACPVSSAQSPPHSAGAPAAKGDSGNELLKHLLKNKKSSSLLNQKPEGSICSEDDCTKDNKLVEKQNPAEGLQTLGAQMQGGFGCGNQLPKTDGGSETKKQRSKRTQRTGEKAAPRSKKRKKDEEEKQAMYSSTDTFTHLKQVRQLSLLPLMEPIIGVNFAHFLPYGSGQFNSGNRLLGTFGSATLEGVSDYYSQLIYKQNNLSNPPTPPASLPPTPPPMACQKMANGFATTEELAGKAGVLVSHEVTKTLGPKPFQLPFRPQDDLLARALAQGPKTVDVPASLPTPPHNNQEELRIQDHCGDRDTPDSFVPSSSPESVVGVEVSRYPDLSLVKEEPPEPVPSPIIPILPSTAGKSSESRRNDIKTEPGTLYFASPFGPSPNGPRSGLISVAITLHPTAAENISSVVAAFSDLLHVRIPNSYEVSSAPDVPSMGLVSSHRINPGLEYRQHLLLRGPPPGSANPPRLVSSYRLKQPNVPFPPTSNGLSGYKDSSHGIAESAALRPQWCCHCKVVILGSGVRKSFKDLTLLNKDSRESTKRVEKDIVFCSNNCFILYSSTAQAKNSENKESIPSLPQSPMRETPSKAFHQYSNNISTLDVHCLPQLPEKASPPASPPIAFPPAFEAAQVEAKPDELKVTVKLKPRLRAVHGGFEDCRPLNKKWRGMKWKKWSIHIVIPKGTFKPPCEDEIDEFLKKLGTSLKPDPVPKDYRKCCFCHEEGDGLTDGPARLLNLDLDLWVHLNCALWSTEVYETQAGALINVELALRRGLQMKCVFCHKTGATSGCHRFRCTNIYHFTCAIKAQCMFFKDKTMLCPMHKPKGIHEQELSYFAVFRRVYVQRDEVRQIASIVQRGERDHTFRVGSLIFHTIGQLLPQQMQAFHSPKALFPVGYEASRLYWSTRYANRRCRYLCSIEEKDGRPVFVIRIVEQGHEDLVLSDISPKGVWDKILEPVACVRKKSEMLQLFPAYLKGEDLFGLTVSAVARIAESLPGVEACENYTFRYGRNPLMELPLAVNPTGCARSEPKMSAHVKRPHTLNSTSTSKSFQSTVTGELNAPYSKQFVHSKSSQYRKMKTEWKSNVYLARSRIQGLGLYAARDIEKHTMVIEYIGTIIRNEVANRKEKLYESQNRGVYMFRMDNDHVIDATLTGGPARYINHSCAPNCVAEVVTFERGHKIIISSSRRIQKGEELCYDYKFDFEDDQHKIPCHCGAVNCRKWMN

SEQ ID NO: 426 - protein, 174 aa, Homo sapiens
PVKDREAFQRLNFLYQVSLRQGPHGDGARRPRVTAPLPQAAHCVLAQDPENQALARFYCYTERTIAKRLVLRRDPSVKRTLCRGCSSLLVPGLTCTHRQRRCRGQRWTVQTCLTCQRSQRFLNDPGHLLWGDRPEAQLGSQADSKPLQPLPNTAHSISDRLPEEKMQTQGSSNQ

SEQ ID NO: 427 - protein, 184 aa, Homo sapiens
CETAKMVVGAFPMAKLLYLGIRQVSKPLANRIKEAARRSEFFKTYICLPPAQLYHWVEMRTKMRIMGFRGTVIKPLNEEAAAELGAELLGEATIFIVGGGCLVLEYWRHQAQQRHKEEEQRAAWNALRDEVGHLALALEALQAQVQAAPPQGALEELRTELQEVRAQLCNPGRSASHAVPASKK

SEQ ID NO: 428 - DNA, 6476 bp, Homo sapiens
cactgactggactgaaaacagggccaagaaaactgctgctgcagggggtcctgaaaacagctggaacccggcagtgatgtgggacctaacttgaagttaacctgtggtggtgaggttggaaccagttggattatgatttattttctacactcttgtacggaatgcagagctgttgtatcctgatgaatctactgctaaatatagtcatttggaataattttaagtattgatcttaaaacttgtaccacaacaagagtgtctaaaaagcacggcaagctcattacgttcttacgaacattcatgaagtctcgtccaacaaaacagaagctgaagcagcggggaatcttgaaagagagggtgtttggttgtgacctgggggagcaccttctaaattctggttttgaagtgccgcagttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagcatctttttccccttccctgcttcattaccccctcttccatctatagactttgtcatttttgtctttagaaaagatctgaaggatggtaaagccccgtgctgaaacccagtagagaaacctgtctcaggacacacttgccatctagggctagcttgaaagagcctgaggactgcctttaactgaatttgaattcagcattgtcctttcttcttagtatttgctgcataattgagagcagttcacatcgatttcctggtaggcgtctgcattccctgttgtgttcctgcttctccttcagtagctgcacaacttgcgcagatcgacacactgttgtcacttcattctccccgtctgagaaggatcttgtgttcagttagagtcgtggaaaaatccctgatccttcaaggtcagtcagacagttggcaacattataattaaaaataagaaattaagactttaaattaaacatttggtagagtcatcataaaacaccagaccacttagactcaggctgaaccatactctttctattcttatttttcatccttgttcctcacggttcagtgaacaggctcatatcatgacagaatggacttttaaaagttagtacttaaggaaacttctttaggtggaagaaagtaaagttcttattgtcagtgaactttattagcaccagaaatctctattgatgcttttaatgcattgcctgccttcaggttttcttcttaccccacccctcaataagatttggtgaattgtaattctagtaaaacatgtcataccattggttttcctaaattatcaactttctttcatt

SEQ ID NO: 429 - DNA, 732 bp, Homo sapiens
tgggatttggtctctttgactaatcaccaaaaagcaaccaactcctccgactcttccttggcttcaaccttagctggggctgcagcagcagagcgagcagctgtggtggcagcagcaacggggcagcagcacaaaggcagatggatcagccaagaaggccttgaccttttcagcaagtgggaaggtgtaatccgtctccacagacaaggccaggaccggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacctgaaaaaaaaaaaaaa

SEQ ID NO: 430 - DNA, 2843 bp, Homo sapiens
gcgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaatactttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactcttttttttaaaaaaaaaaaaaaaaaaaaaaactcgag

SEQ ID NO: 431 - DNA, 640 bp, Homo sapiens
ggtaacgttatagtatttgtcagaagttggggtctccgtgggcattgtgatccgtcccaggcagtggattaggaggccagaaggagatcccttccacggtgctaggctgagatggatcctctcagggcccaacagctggctgcggagctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgtcatctgtgaagactgccaggcctaggctctctgtagagagtcttcaagatcccggagtggtagcgctgtctcctggtgaaggagtatttgtcacactggaatgtgactgtgtgtgtatgtatgtgtatatatatatatatatatatatataaacaagtttgttgacacctacaaaaaaaaaa

SEQ ID NO: 432 - DNA, 2068 bp, Homo sapiens
cctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatactgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagagtttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaat

SEQ ID NO: 433 - DNA, 1723 bp, Homo sapiens
tttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgcctttccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacat

SEQ ID NO: 434 - protein, 1702 aa, Homo sapiens
AAVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGAVTHDPPQDSVPVSSVSLIPPPPPPKNVARMLALALAESAQQASTQSLKRPGTSQAGYTNYGDIAVATTEDNLSSSYSAVALDKAYFQTDRPAEQFHLQNNAPGNCDHPLPETTATGDPTHSNTTESGEQHHQVDLTGNQPHQAYLSGDPEKARITSVPLDSEKSDDHVSFPEDQSGKNSMPTVSFLDQDQSPPRFYSGDQPPSYLGASVDKLHHPLEFADKSPTPPNLPSDKIYPPSGSPEENTSTATMTYMTTTPATAQMSTKEASWDVAEQPTTADFAAATLQRTHRTNRPLPPPPSQRSAEQPPVVGQVQAATNIGLNNSHKVQGVVPVPERPPEPRAMDDPASAFISDSGAAAAQCPMATAVQPGLPEKVRDGARVPLLHLRAESVPAHPCGFPAPLPPTRMMESKMIAAIHSSSADATSSSNYHSFVTASSTSVDDALPLPLPVPQPKHASQKTVYSSFARPDVTTEPFGPDNCLHFNMTPNCQYRPQSVPPHHNKLEQHQVYGARSEPPASMGLRYNTYVAPGRNASGHHSKPCSRVEYVSSLSSSVRNTCYPEDIPPYPTIRRVQSLHAPPSSMIRSVPISRTEVPPDDEPAYCPRPLYQYKPYQSSQARSDYHVTQLQPYFENGRVHYRYSPYSSSSSSYYSPDGALCDVDAYGTVQLRPLHRLPNRDFAFYNPRLQGKSLYSYAGLAPRPRANVTGYFSPNDHNVVSMPPAADVKHTYTSWDLEDMEKYRMQSIRRESRARQKVKGPVMSQYDNMTPAVQDDLGGIYVIHLRSKSDPGKTGLLSVAEGKESRHAAKAISPEGEDRFYRRHPEAEMDRAHHHGGHGSTQPEKPSLPQKQSSLRSRKLPDMGCSLPEHRAHQEASHRQFCESKNGPPYPQGAGQLDYGSKGIPDTSEPVSYHNSGVKYAASGQESLRLNHKEVRLSKEMERPWVRQPSAPEKHSRDCYKEEEHLTQSIVPPPKPERSHSLKLHHTQNVERDPSVLYQYQPHGKRQSSVTVVSQYDNLEDYHSLPQHQRGVFGGGGMGTYVPPGFPHPQSRTYATALGQGAFLPAELSLQHPETQIHAE

SEQ ID NO: 435 - protein, 160 aa, Homo sapiens
PFQQVGRCNPSPQTRPGPASKVKQDMPPPGGYGPIDYKRNLPRRGLSGYSMLAIGIGTLIYGHWSIMKWNRERRRLQIEDFEARIALLPLLQAETDRRTLQMLRENLEEEAIIMKDVPDWKVGESVFHTTRWVPPLIGELYGLRTTEEALHASHGFMWYT

SEQ ID NO: 436 - protein, 396 aa, Homo sapiens
RAQEAAAAAADGPPAADGEDGQDPHSKHLYTADMFTHGIQSAAHFVMFFAPWCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENTFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 437 - protein, 92 aa, Homo sapiens
AEMDPLRAQQLAAELEVEMMADMYNRMTSACHRKCVPPHYKEAELSKGESVCLDRCVSKYLDIHERMGKKLTELSMQDEELMKRVQQSSGPA

SEQ ID NO: 438 - protein, 303 aa, Homo sapiens
KNPAKMSLYPSLEDLKVDKVIQAQTAFSANPANPAILSEASAPIPHDGNLYPRLYPELSQYMGLSLNEEEIRANVAVVSGAPLQGQLVARPSSINYMVAPVTGNDVGIRRAEIKQGIREVILCKDQDGKIGLRLKSIDNGIFVQLVQANSPASLVGLRFGDQVLQINGENCAGWSSDKAHKVLKQAFGEKITMTIRDRPFERTITMHKDSTGHVGFIFKNGKITSIVKDSSAARNGLLTEHNICEINGQNVIGLKDSQIADILSTSGTVVTITIMPAFIFEHIIKRMAPSIMKSLMDHTIPEV

SEQ ID NO: 439 - protein, 378 aa, Homo sapiens
VVPSTKDFLVGVKGSGGHRGGGEMAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQNPRTVPVQPAFSTVPFSQPVCFPPRPRGRRQKPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 440 - DNA, 2239 bp, Homo sapiens
ggaggttgaagtgagcagagatcatgccagcctgggtgacagtgagactctgtctcaaacagaattaaggaaaaaagaaagaaagaaaaagagagagaggaaattccaggccaattgtggcatagattttatcatattctggattttttggattcttttgttttctcatcactggattcaggaaagcctgttgtgtccaccatctccaaaggaggttacctgcagggaaatgttaacgggaggctgccttccctgggcaacaaggagccacctgggcaggacgccttttcaggaagagacgccttttcaggaagagacgccttttcaggaagagagaaagtgcagctgaagaggaaagtcactttactgaggggagtctccattatcattggcaccatcattggagcaggaatcttcatctctcctaagggcgtgctccagaacacgggcagcgtgggcatgtctctgaccatctggacggtgtgtggggtcctgtcactatttggagctttgtcttatgctgaattgggaacaactataaagaaatctggaggtcattacacatatattttggaagtctttggtccattaccagcttttgtacgagtctgggtggaactcctcataatacgccctgcagctactgctgtgatatccctggcatttggacgctacattctggaaccattttttattcaatgtgaaatccctgaacttgcgatcaagctcattacagctgtgggcataactgtagtgatggtcctaaatagcatgagtgtcagctggagcgcccggatccagattttcttaaccttttgcaagctcacagcaattctgataattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaaaaccattccccttgcaatatgtatatccatggccattgtcaccattggctatgtgctgacaaatgtggcctactttacgaccattaatgctgaggagctgctgctttcaaatgcagtggcagtgaccttttctgagcggctactgggaaatttctcattagcagttccgatctttgttgccctctcctgctttggctccatgaacggtggtgtgtttgctgtctccaggttattctatgttgcgtctcgagagggtcaccttccagaaatcctctccatgattcatgtccgcaagcacactcctctaccagctgttattgttttgcaccctttgacaatgataatgctcttctctggagacctcgacagtcttttgaatttcctcagttttgccaggtggctttttattgggctggcagttgctgggctgatttatcttcgatacaaatgcccagatatgcatcgtcctttcaaggtgccactgttcatcccagctttgttttccttcacatgcctcttcatggttgccctttccctctattcggacccatttagtacagggattggcttcgtcatcactctgactggagtccctgcgtattatctctttattatatgggacaagaaacccaggtggtttagaataatgtcagagaaaataaccagaacattacaaataatactggaagttgtaccagaagaagataagttatgaactaatggacttgagatcttggcaatctgcccaaggggagacacaaaatagggatttttacttcattttctgaaagtctagagaattacaactttggtgataaacaaaaggagtcagttatttttattcatatattttagcatattcgaactaatttctaagaaatttagttataactctatgtagttatagaaagtgaatatgcagttattctatgagtcgcacaattcttgagtctctgatacctacctattggggttaggagaaaagactagacaattactatgtggtcattctctacaacatatgttagcacggcaaagaaccttcaaattgaagactgagatttttctgtatatatgggttttgtaaagatggttttacacactacagatgtctatactgtgaaaagtgttttcaattctgaaaaaaagcatacatcatgattatggcaaagaggagagaaggtagagctgttcttaaatttattaaaaaaaaaaaaaaa

SEQ ID NO: 441 - DNA, 5981 bp, Homo sapiens
aggttgaagtgagcagagatcatgccagcctgggtgacagtgagactctgtctcaaacagaattaaggaaaaaagaaagaaagaaaaagagagagaggaaattccaggccaattgtggcatagattttatcatattctggattttttggattcttttgttttctcatcactggattcaggaaagcctgttgtgtccaccatctccaaaggaggttacctgcagggaaatgttaacgggaggctgccttccctgggcaacaaggagccacctgggcaggagaaagtgcagctgaagaggaaagtcactttactgaggggagtctccattatcattggcaccatcattggagcaggaatcttcatctctcctaagggcgtgctccagaacacgggcagcgtgggcatgtctctgaccatctggacggtgtgtggggtcctgtcactatttggagctttgtcttatgctgaattgggaacaactataaagaaatctggaggtcattacacatatattttggaagtctttggtccattaccagcttttgtacgagtctgggtggaactcctcataatacgccctgcagctactgctgtgatatccctggcatttggacgctacattctggaaccattttttattcaatgtgaaatccctgaacttgcgatcaagctcattacagctgtgggcataactgtagtgatggtcctaaatagcatgagtgtcagctggagcgcccggatccagattttcttaaccttttgcaagctcacagcaattctgataattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaaaaccattccccttgcaatatgtatatccatggccattgtcaccattggctatgtgctgacaaatgtggcctactttacgaccattaatgctgaggagctgctgctttcaaatgcagtggcagtgaccttttctgagcggctactgggaaatttctcattagcagttccgatctttgttgccctctcctgctttggctccatgaacggtggtgtgtttgctgtctccaggttattctatgttgcgtctcgagagggtcaccttccagaaatcctctccatgattcatgtccgcaagcacactcctctaccagctgttattgttttgcaccctttgacaatgataatgctcttctctggagacctcgacagtcttttgaatttcctcagttttgccaggtggctttttattgggctggcagttgctgggctgatttatcttcgatacaaatgcccagatatgcatcgtcctttcaaggtgccactgttcatcccagctttgttttccttcacatgcctcttcatggttgccctttccctctattcggacccatttagtacagggattggcttcgtcatcactctgactggagtccctgcgtattatctctttattatatgggacaagaaacccaggtggtttagaataatgtcagagaaaataaccagaacattacaaataatactggaagttgtaccagaagaagataagttatgaactaatggacttgagatcttggcaatctgcccaaggggagacacaaaatagggatttttacttcattttctgaaagtctagagaattacaactttggtgataaacaaaaggagtcagttatttttattcatatattttagcatattcgaactaatttctaagaaatttagttataactctatgtagttatagaaagtgaatatgcagttattctatgagtcgcacaattcttgagtctctgatacctacctattggggttaggagaaaagactagacaattactatgtggtcattctctacaacatatgttagcacggcaaagaaccttcaaattgaagactgagatttttctgtatatatgggttttgtaaagatggttttacacactacagatgtctatactgtgaaaagtgttttcaattctgaaaaaaagcatacatcatgattatggcaaagaggagagaaagaaatttattttacattgacattgcattgcttccccttagataccaatttagataacaaacactcatgctttaatggattatacccagagcactttgaacaaaggtcagtggggattgttgaatacattaaagaagagtttctaggggctactgtttatgagacacatccaggagttatgtttaagtaaaaatccttgagaatttattatgtcagatgttttttcattcattatcaggaagttttagttatctgtcatttttttttttcacatcagtttgatcaggaaagtgtataacacatcttagagcaagagttagtttggtattaaatcctcattagaacaaccacctgtttcactaataacttacccctgatgagtctatctaaacatatgcattttaagccttcaaattacattatcaacatgagagaaatcaccaacaaagaagatgttcaaaataatagtcccatatctgtaatcatatctacatgcaatgttagtaattctgaagttttttaaatttatggctatttttacacgatgatgaattttgacagtttgtgcattttctttatacattttatattcttctgttaaaatatctcttcagatgaaactgtccagattaattaggaaaaggcatatattaacataaaaattgcaaaagaaatgtcgctgtaaataagatttacaactgatgtttctagaaaatttccacttctatatctaggctttgtcagtaatttccacacacacacacactttttatatatatatatatatatatatatatagtggaacttacaaatgagagtaatataatgatgaaattttgaactgttatttataaacatctaaggtaaaatggttagtcatggccagagtatgtttcatcctttaatttttgtccatttgaaaataaggatttttgaaagaattataccaattaaaattattaaaggcaaacatagaattcataaaaaattgtccaaagtagaaatgatgacctataatttggagcatttccaattcagtaatttcaattttgctcttgaaaacatttaatatatatccaagactgacatttctttagctgaacctaacgtttgggtctctgagtgaatttataataactccttccttccttagcatagggttttcaaaatttgatttataattcctatttccagtaaatattgttcatttgtccacatctctccctatgatatgttgctggaggtaagaatttctttcatattcctattttttttttccccatagactaggctcatagaatttaaacaagcaaattttcctgagctttttcttgccaaatgaaagaagactggtaaattctcatagagaggtttgtgtagttcttggctcttcctggggttaatgtgcttatattcacagtggcaaattggtctcagactttaatttatttatttttgatttgaatttctctttaaaagtatcaatttaaaaggtaactagaattattctttctcattttcaaaagtgatttttgcattattaaatttccctgccattgtaatgccatttcacgcagaaaaaaagtcagccagtaattaagaaaaaaagtgatggagattaagtagtattttggcttatttttaggactcatcatgagaagacacagttcctttaatcaggaaattaatatccataattttcactcaaaattgcagtatgtaaagcagattctcaaaaactctcctgaacacttatttatatatatgtttttatataagtaaaatttttctcatatttttatacgatatgcacacacacacatacatgcacatactacttactacatgttctgtacttgtactttgtaccatgcatattcaaatgtttatatacataagtttattataacataaacagtaaaagtaatgaatactgtttaaaataactaatatagtattttttaatttttgtggggatggattctcaaatacttgtgattttaaaagattctaaagctaaaacacaacttgattttaaaaagaatgattctccttacacaattataaatatttgcagtaaatattttccttataatactgttttgaccccatttaaaaagtattagattatattcctttgatccaatgaaaactgaaccttataaatggttagctgaaagtagaccttattcttgtccttctttagaagagtaaagatttgtcctagggaagatggctgacttcggttcccaacatgcgtatgcatttagactgtagctcctcagccctgtggacacaaaatttggacagcttattaggttacgttagcaatgcatgacggtttctccaacactaagatattcacgttgaaacagatttcctgttcgtcttatgtgtctggtaaaattgtttccccaattacaatttgacatatcaatagagggttaacaagagtataattacataacagaattcctcatgaactgtaatcagtctacaggaaaatcattattttatcttgatttgcagatgaatatactgctaagaaagggagcaactctgacctttgttaaagttgatcttttgtaattgaggtataaggtatgaaaagataaaaaaccgaaggccagagaatcaggaaatgaaagatagtatggactgaaggtaacaatattttaatgttatgcaatatagccagagaaatattaaaaattagttgtttgctgtgcataggtggatctcgcaggaagctaatgaaacctaagcttcagtgcctctcacttagacatgttccattcgaggtcctgaacctaactttgtattaggaattctgtactaattttgttgaagaagaccagcaaagttgtgtacacttctacccccacaaaatctgcattgtccatgtgagtaaagtaaaataattcctgttatttttttctgttagaaataagtatggaggatatgtttttaaaaatttatgagttaattgaaatatccatatataacaagtgactttctcacaatatatatgatgtgatatatagggagatagtttcactttcatcatattttatacgttgattctgaactatagaaaaataataaatgggattttaattatagctcttagttgggaaagaaatatagagagatgtgggatttgaatgcccatgaaagacattttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagcttaattttcatataaacagtatttttaatctatgttaaaatagataatatctaaaagtgtgatctctaggtagtccttagtttattagtactgtacttcaaaaagatttttaaataggtccggcacggtggctcatgcctgtaatcccagcactttgggaggctgaggcgggcgaatcacctgaggtcaggagttcgagatcagcctggccaacatggtgaaaccctgtctcaactaaaaatataaaaattagccgggcgtggtggcaggcgcctgtaatcccagctactcgggaggctgaggcaggagaatcacttgaacccaaggggcagaagctgcagttagccaagatcgcatcattgcactccagcctaggggacaagagcgcgagacttcatctc

SEQ ID NO: 442 - DNA, 337 bp, Homo sapiens
gatggaggttgaagtgagcagagatcatgccagcctgggtgacagtgagactctgtctcaaacagaattaaggaaaaaagaaagaaagaaaaagagagagaggaaattccaggccaattgtggcatagattttatcatattctggattttttggattcttttgttttctcatcactggattcaggaaagcctgttgtgtccaccatctccaaaggaggttacctgcagggaaatgttaacgggaggctgccttccctgggcaacaaggagccacctgggcaggagaaagtgcagctgaagaggaaagtcactttactgaggggagtctccattatca

SEQ ID NO: 443 - DNA, 739 bp, Homo sapiens
gaattcgaaccccttcggattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtattgaattttctctgcctttaataaaagaaagtggccataagaaggagacagcatctggaacaagcttgggatatggggagga

SEQ ID NO: 444 - DNA, 738 bp, Homo sapiens
  misc_feature (1)...(738): n = A,T,C or G
ttttttttttttcgttnaaaagaaattttatttctanantggaatgatttggatgtgacctgataaatacagtttgttattgnggtctcattaaattaatcagctttttcacactggggtaaagaaacagatgatgatactagggaatggaaacaaaattggaaacctgggttatttggggatttatattgtactctgcacagttgcccttttttttaggcgtgttccctggaaaagagggacggatgaacctggaagtaagtaaaagacattctaggtgtgtagcatcaaggcagttaatatccaagcatcagctttctctttatacatctacactgcatggcctgcaccaaataaggaactgaaccaggggtatgtttttacctccacagctgcctccttccatcanagcaccttgatgaacttaatgtctagtcacacgtcattggcatgttttctccccagcatttaattacaaagctttctttctttggataggatcagttcttaagagcagccccggtaactggaggaatgggagccgttttgatganaaaaatgggtttggtgttcaggatctccaattataaatgtagtctctcagcaccacattccgtaaagatgatttcccaagtaacggtatttgactaagttgctccagagtgttaggggcaaaccacagttagtaagctccttatgaacaacccccatatcaagtactttgtccatttgcaggca

SEQ ID NO: 445 - DNA, 716 bp, Homo sapiens
gcggccgctagtgctccagctcgcgctccgccctcaggcacagcatccccacgggcctccacgccaacctgtccgagggccgccccgtgggtccggcccgccgtggcgcctcatcgctgctcggcccggaaggcttcttccttggcaagatgggattccgggaggcggtggcggccggagacgtggatttgcctcaggtgcggagccgcagctacaggaggatgctcgcgaggacccccagagctccgcccggagggtactgtgaggccgttaggagctggcggtggatgacttccgcattcaaacactggagccatcacacggaagcacgaggagggtatcctcggcagctactcccggtcgctcaaggtgtctctcgctcgccctctaggtgcgggaggagctcgaggcccaactaagctgcttccgggagctgctgggcagggcccccacgcacgcggacgggcaccagcacgtgcacgtgctcccaggtggacagacgccttcgtgggcctgagcacttgcggccggcacatgtccgctcaccgcgtgtccggggccctggcgcgggtcctggaaggtaccctagcgggccacaccctgacagccgagctgatggcgcaccccggctaccccagtgtgcctcccaccggcggctgcggtgaaggccccgacgctttctctttgctcttgggaagcggcttgcattgagcttg

SEQ ID NO: 446 - DNA, 641 bp, Homo sapiens
  misc_feature (1)...(641): n = A,T,C or G
gctncagctcgcgctccgccctcaggcacagcatccccacgggcctccacgccaacctgtccgaggnccgccccgtgggtccggcccgccgtggcgcctcatcgctgctcggcccggaaggcttnttccttggcaagatgggattccgggaggcggnggcggccggagacgtggatttgcctcaggtgcggagccgcagctacaggaggatgctcgcgaggacccccagagctccgcccggagggtactgtgaggccgttaggagctggcggnggatgacttccgcattcaaacactggagccatcacacggaagcacgaggagggtatcctcggcagctactcccggtcgctcaaggtgtctntcgctcgccctctaggngcgggaggagctcgaggcccaactaanctgcttccgggagctgctgggcagggcccccacgcacgcggacgggcaccagcacgtgcacgtgctcccaggnggacagacgccttcgtgggcctgancacttgcggccggnacatgttccctcacccgcgggtccgggcccttggcgcgggtcctggaaggtaccctacgggccacaccctgacagccgaactgatggcccaccccggctaccccangtgtgcctccacccg

SEQ ID NO: 447 - DNA, 652 bp, Homo sapiens
  misc_feature (1)...(652): n = A,T,C or G
gaattcgaaccccttcgcttttagaaaattgtatatgcagctggatgaaggcagcctcacctttaatgccaacccagatgagggagtgaactactttatgtccaagggtatcctggatgattcgccaaaggaaatagcaaagtttatcttctgtacaagaacactaaattggaaaaaactgagaatctatcttgatgaaaggagagatgtcttggatgaccttgtaacattgcataattttagaaatcagttcttgccaaatgcactgagagaattttttcgtcatatccatgcccctgaagagcgtggagagtatcttgaaactcttataacaaagttctcacatagattctgtgcttgcaaccctgatttaatgcgagaacttggccttagtcctgatgctgtctatgtactgtgctactctttgattctactttccattgacctcactagccctcatgtgaagaataaaatgtcaaaaagggaatttattcgaaataccccgcgcgctgctcaaaatattagtgaagaattttgtanggcatctttatgacaatatctacccttattgggccatggnggctggcataaaaaagcaccaattggctaaggactttcaagttttttactttcagaacttaaaagcttaccc

SEQ ID NO: 448 - DNA, 677 bp, Homo sapiens
gaattcgaaccccttcggcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagccgaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttcatgagggcgacgtcatcacgctgaccaaccagatcgatgagaac

SEQ ID NO: 449 - DNA, 603 bp, Homo sapiens
  misc_feature (1)...(603): n = A,T,C or G
ttttttgtanaaagagacatttaatacttctgtttacaaaattcaggcgtacatttcagtttgccctggaccgtgcccaaagctgtgtgctcatctctgcgcccctcatgtacttctgacgaggggggtgcagggcagggcagagcagagcctggggtccggaggcttcactggaccacagggggaggggaatgtgaatgtggcctggcccanagaactccccatttcatcgattttgcattgggcgatagaggaagcagatgtcggggctgcctgccttggtctanaggagatggctggggccacttcccacagggtgaagtggcagcggctcagcaaggggagcctggccaccaggggctgggacatgcgctcactggaacctttgtgcttggccctcggcagcgcggctgtggtcccgtgtgaggtgtgctggggtggggtgtgggtggctggtggtggcagcttgtgccagagtgacacaggcctccctgggttgggatgggggcaagttaaaaagctgaaaaggtacttggctttctgagggcgggcttgggagcaggccctgcagganaccatgttctctgtcctcagcagatccac

SEQ ID NO: 450 - DNA, 678 bp, Homo sapiens
  misc_feature (1)...(678): n = A,T,C or G
gaattcgaaccccttcgcatcaatataanatgccacccatctgcagttaatttcttttcctcatcatgtgattaaaagtggtgattcagtgggaactgggaatgtttttagctggtggtagaaggctgcctacactgggcactgttttagattctcatatcatttaaacagcaaggaggttcagggaagaataaccgtagccttgggtaatccactagggcttttgtgagtaggagagctgatacctcacattcttagcaggtgaaaacttgccatgatggaaacagatagtgaagagttactgacgtatcccaaattatatgctgtgacataaattcccagcatgcccagccctgatttctgagttcataagtaattctagtgaaccttagtaggaattctgggtaagaaaatgaggttgccattggtcttgtttgcatcaccaagaccagacatccagaagagcccctcaccttgaaaagcagacagattttaaattaaccccctccttcccactcaccttcatctccctaagagttttggccatttaattccacattttgaaaggaatacattggtgaaatttgggaagagaatctgtgctatgcaatgtttcattaaaatcttcagtttttcaagtctctctaaaaataatttgtagatctatcttggatggat

SEQ ID NO: 451 - DNA, 651 bp, Homo sapiens
  misc_feature (1)...(651): n = A,T,C or G
tttttcatcaacaaaaatcaagcattttcntttttttgaaacaagaaaagcgcatcgtanaaaccaagattctgtacaatattctaacattatatgtacataaaattatattactcataactatattgaaaagtcttatttgtagaatatggctggcaacaaagaaagacccataccatttagcgtttgaagcagggcaggtagcaagagaacattagcaaagacacctttgtgcctggatacacaatcctgctactaagttatgtgactaaccagcacactctaagttctgtggtttgttcgttgtttcacattctagtagggaattctgcagcaggcgatgcgaaaaanaanacatggtcaaatgaaatgtgaaatgctgtttaaaatctgcatattggctatgataatgggtttgngaatccaagttgcattggaagttcactcattctccattcattatgcatgcctccagtgatttaatgaatttcagcaggnggaaaagacagctttgaacagatcagatgggctgtgagtcanattcttgattctttttcctcatttggctcctgaatgttgcanaaaactggttttgtacactggggaaggagagagtgaagaccctccagttggttcctcagtcagctccgt

SEQ ID NO: 452 - DNA, 679 bp, Homo sapiens
  misc_feature (1)...(679): n = A,T,C or G
gaattcgaaccccttcgcattgctcagccnnctaccactgctaagagccatctccaccagaagcctggccagacctggaagaacaaagagcatcatctctctgacagagagtttgtgttcaaagaacctcagcaggtagtacgtagagctcctgagccacgagtgattgacagagagggtgtgtatgaaatcagcctgtcacccacaggtgtatctagggtctgtttgtatcctggctttgttgacgtgaaagaagctgactggatattggaacagctttgtcaagatgttccctggaaacagaggaccggcatcagagaggatataacttatcagcaaccaagacttacagcatggtatggagaacttccttacacttattcaagaatcactatggaaccaaatcctcactggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagaagagaatggagactacacatatgtggaaagagtgaagatacccttggatcatggta

SEQ ID NO: 453 - DNA, 630 bp, Homo sapiens
  misc_feature (1)...(630): n = A,T,C or G
gaattcgaaccccttcggaaggccaagggnntagaaggnggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacacccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttccacaggtgaactc

SEQ ID NO: 454 - DNA, 677 bp, Homo sapiens
  misc_feature (1)...(677): n = A,T,C or G
gaattcgaaccccttcgcccgcatgcggnacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggcaaagccattggcttggagatcaagctttgtattgttggccaaagcccgagagagtgcctcagctaaaataaaggaggaggaagctgctaaggactagttctgccttcccgtcacccctgtttctggcaccaggaatcccccacaatgcacttgatggtggggttttaacatgt

SEQ ID NO: 455 - DNA, 598 bp, Homo sapiens
  misc_feature (1)...(598): n = A,T,C or G
ttttttggtttataggagagatttatttgaagaaatattacaacatataaaaactacataaagtcttaatttccactcatacagtggtagatttgatataatgcataataaaaaacttttaaaatccagaatgcacaaagtactgcacaatttgatcactaaatcattagttgataagcgaacctcacacaacagcttcatgtcagccaaggccacaaacaccatgtaccacacatgtgaacggacagattgacatgttaaaaacacaacatcagtgcatgttggggattcctggtgccagaaacaggggtgacgggagggcagaactagtccttagcagcttcctcctcctttattttagctgaggcactctctcgggctttggccaacatacaaagcttgatctccaagccaatggctttggccaggggcggtggcacggcattgcccacctgccggtgcttngtccaggatgttgcccgaagagccggtaggtggtcaagggaagcccctggggaagcgggcacactcccggacgctnaccacacggtgctgnttttgggtggagcaccgcggccttgcttgcccatgggctcgg

SEQ ID NO: 456 - DNA, 574 bp, Homo sapiens
ggaattcgaaccccttcggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgcttcatcaacaccacctggcgacctttaaaatttgtgaatttccggcctggcccccggattgcccgaat

SEQ ID NO: 457 - DNA, 546 bp, Homo sapiens
  misc_feature (1)...(546): n = A,T,C or G
ttttttgacacatctctatatttatatattagacgggtcagggaggtggcaggggcgccgggctctccacgccccccagctccacttctgctcaccacacacagaagcagcgagggcacgcgaagtgacagctttgacagggaggggattcggcccggcctggctcctcagggatgctagcccttgagactaaggaatgttccttcagggaaactagggtggggtttgaatganatgaggggggcaggcatggccctgagtccctactcagcgccccccaccctccacctctgcccttcagcaggttggggcagccagaacccttccattccagaactgccagagactgggacgctggggaaggtaagggcgcagcagcagcagcgggagattgaactggggccacctgagctcccgaggccccgtggggagggcgggtggggaggaaaaggccttggcctgcctgaagctggaggcctcagcaaaggagagaggtggccaggcccatgctccaccccggcctgggctgccaanggtcccgggctg

SEQ ID NO: 458 - DNA, 674 bp, Homo sapiens
gaattcgaaccccttcggtattattaagaactaagagaatagcttgccagatacaaatggaaacaccttccaaatgagtcggagaaaatgtcttgcagtattatgggtaaaatagcaaagagcttgggaatacagtttgctaatatcaagtccttaacaacgaccattcttcattcaagattagttgtgtataaatacatgcttcttcaggagttgacttagaaaacaagcaaacaaacaaacatcagaaactatttacaactgggagcaatccttgaagaacataaagaatataaatatcaacaaaggctgaaaactcttttttagattaaagatcaaatggacatgtcatcggaatgtattgtatggctcttgattaaatcctggagcaaagtggagagtgaggaacaactgtaaagaatgtgaatacggactgtgtattagataacagtaccataaatttcctggatgggataattatgttgtgactatgtaagagaatattttgcccttagaagatatatgatgaagcatttagaagtaaagtatcatgacatcttgcaaataactttcaagtgattcagccagatatataaaaattatatataacacattatataatttatatttatataattataatacattatataatttatacattataattatat

SEQ ID NO: 459 - DNA, 682 bp, Homo sapiens
tttttttaaatccatggcttgttaattgtcatcccagttatttacatgtgactatagagactgcattctcccagctgccaggccgccagggctttgccactggtataatttataacacgactaattaaaatgaatttgcttgcaataaggttctgtgtgctatttgtgggagaggagttattaaaattttcagtacagtaatagtaaacttgaatgcaaagtaataataatcatacatttttaattacatgtttaatacccatttggctaatgtagaactattctgaaaattacttgggatcagcacaatgtctttttgtgcttagtagtatccaaagacatccttctgaatgggcttagcaatatgcactgtcatcaagatacagctgtttgatgacagacacacagtgtgttcctatgatactttgcacaagatcagctatgacaaatacaagttcattttgcttattgcaggcaaataatgtcctttgcaggaacttggatggagccagaggccattattctaagtgaaatacctcaggagtggaaaaccaaataccatatgttctcacttacaagtgggaactaagctatgggtacacaaacgcatatagagtaatggactctggcgactcatactacatattgagtacaatgtacactacttgggtgatgggtgcac

SEQ ID NO: 460 - DNA, 663 bp, Homo sapiens
  misc_feature (1)...(663): n = A,T,C or G
gaattcgaaccccttcgcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaaganaagcagcatctggcatatacaggctcttcgactac

SEQ ID NO: 461 - DNA, 612 bp, Homo sapiens
  misc_feature (1)...(612): n = A,T,C or G
ttttttgggatccaatctntttattgtcagggtcccctccctgnggccccccgccaaacctatagaaaaaacccaagcctgggagtgtcctggggaggggaggtagtatggggaaacccctgtgctctaccctntggcctgggcagtgcanacagggagggctcatggggaaggagtaggccagtaactccacctgcanaggacatggcactggctgggatgcgttgggggaggaggcgcctgctgccagctttcctntggtacccgctggggggtggcatccagggttgggtgcccggcttgaggcctggggcagcgatgcccttcacctgctggnggccattgctcctgtcaggctgcttactgcaaggccccatcatccgcgtctgtgtcctggctgtgttccagctcttcctcgctgngtgtcaggagcccttcctcatcgccgtcgtctcgggtccgtgcttccccctggggcaggcctgcctcanaagttgtgttctcttggggggctggtggccggttgttgccaccgcaccgcaccaccactggcaccggcaccgntgcaccaccaccgccgccgccgccgntggngccaccttcatcaccctt

SEQ ID NO: 462 - DNA, 672 bp, Homo sapiens
gaattcgaaccccttcggatggaaggggccggggcagcgtcggggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacgcccgatctgctcaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgccctggccaagcaggaggagctggagcgggacctggcccagcgctccgaggagcggcgcaagtggtttgaggccacagacagcaggaccccagaggtgcctgctggtgaggggccgcgccggggcctgggtgccccctgactgaggaccagcaaaaccggcttagtgaggagatcgagaagaagtggcaggagctggagaagcttgcccttgcgggagaataaccgg

SEQ ID NO: 463 - DNA, 562 bp, Homo sapiens
  misc_feature (1)...(562): n = A,T,C or G
ttttttaaagtataaagtgttttggaaaaaaaggaaaaanntctatataaaaatctcttcacatataaaatcctgaagaaggtgcaaggtgagacccagtgcgaggggcgtgctcagatatgcagtgtgtgtgtgtgtgtgtgtgtgtgtgtatccgtgtgtacatgtgtgcacgtgtgtgcgtatgtgtctgtgtgtctgtgtgtgtgtgtgtgtgtgtgtgtgtgtgtggtgggtgcaagtgcacgtgtggcccacagagggtggggagaaagcttggctttttacttccatccaggagggaaggagggcggctggtcctccagcctggagggtctgcagctgggcgggacctctactcagccaggctgttgcgcatcgactccttctcctggagggcggccatggcaagacgcaggtgctccttcagctgctcgatctcccgctcagaccgtgtcttgatgtggctcaactccacatagacgtcctggtactttcccnaggtgaagcgcttgtccttctgcatcatctggagctcgtcccggaggcactgcaccttcct

SEQ ID NO: 464 - DNA, 553 bp, Homo sapiens
gaattcgaaccccttcgggaccaggaacccaggagagcatggccacgctgcgccggcttcgggaggcgccgcggcacttactggtttgcgagaaatccaacttcggcaaccacaagtcgcgccaccggcatcttgtgcagacgcactactataactacagggtttcatttctcattcctgaatgtgggatactatcggaagaactgaaaaacctggtcatgaacactggaccctattactttgtgaagaatttacctcttcatgaattaattacacctgaattcatcagtacctttataaagaaaggttcttgctatgcactaacatacaatacacatattgatgaagataatactgttgccctgctaccaaatgggaaattaattttgtcactggataaagacacttatgaagaaactggacttcagggtcatccatctcagttttctggcagaaaaattatgaaatttagttcagaagaatcgacaatgatgtcatatttttccaagtaccaaattcaggagcatcagccaaaagtagcactgagcccgtt

SEQ ID NO: 465 - DNA, 383 bp, Homo sapiens
  misc_feature (1)...(383): n = A,T,C or G
tttttggaagaaaacacgatttttaatttttattttttatgggggacagngatcatttgccccaacagccatntgaagccaatagtcctgattattaaaaatcacaaagttatataaatgntctcctccttttcgaaaaccatgttcatttttttcccaanaaacagggctgtctgcaaagccttgaacggacagngtaacccatggagctaacttcggttcatcaaagtagngacaganatgttccaatagganacagatcttntntggaagtatgaagccagngattgtacacaaataagcttttgccaccactgtgcttggctcaggacagcaataggttgatatgaaattattaggctcattatttaggncgacattac

SEQ ID NO: 466 - DNA, 673 bp, Homo sapiens
gaattcgaaccccttcgctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaaggtagcgcggaaccagcttctctgacggcgctgctcttcgacccagcccaggccgccactgaattttgtgtctgtaatttttctttgacagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgcc

SEQ ID NO: 467 - DNA, 373 bp, Homo sapiens
  misc_feature (1)...(373): n = A,T,C or G
tttttactggaacgacagcttattntttaataaaagtcaggggngtcagcagngtcactggtaanacatgatggcgctccacgactgaccagcagcgctgggaagggacacgcanaacccaccttccaaccacgcccaacacatnacanaaatgcctgctcgtttgttttgattcatatacaaagttacaaagtatttcctgccccaaattnttaacgaaaatgaaagaaaaccctanaatgcgggggttttacaagtatattagcccanaacatcctaggcagctgcncgggccgcgggtgcggcagggcgcagggcaacacccaaagccccggccagcgcgaaacggacgcaggcgcatccccagccctcc

SEQ ID NO: 468 - DNA, 573 bp, Homo sapiens
  misc_feature (1)...(573): n = A,T,C or G
gaattcgaaccccttcgctgctgtcctacttgatgcttgtcactgtcatgatgtggcccctngctgtgtaccaccgactgtgggatcgagcatatgtgcggctgaagccagctctgcagcggctagacttcagtgtccgtggctacatgatgtccaagcagagagagagacaattacgccgcagagctctccacccagaacgagccatggacaaccacagtgacagcgaagaggagcttgctgccttctgtcctcagctggacgattctactgttgccagggaattggccatcacagactctgagcactcagacgctgaagtctcctgtacagacaatggcacattcaatctttcaaggggccaaacacctctaacggaaggctctgaagacctagatggtcacagtgatccagaggaatcctttgccagagaccttccagacttcccttccattaatatggatcctgctggcctggatgatgangacgacactagcattggcatgcccagcttgatgtaccgttctccgccagggggctgaggagccccaaggccccacctgccagcccggg

SEQ ID NO: 469 - DNA, 635 bp, Homo sapiens
  misc_feature (1)...(635): n = A,T,C or G
tcncgatctagaactaggttggacaggcttgctcaagtttcaccagagttantactggcctctgttcgcagagtttttagttnnacactgcagaattggcagactacacggtttatggaagttgaagtagcaataagattgctgtatatgttggcagaagctcttccagtatctcatggtgctcacttctcaggtgatgtttcaaaagctagtgctttgcaggatatgatgcgaactgtaagtatactggagataattttgaccataaatttctgttttcagtataagctaatgggagttccttaattgttagagcttagtatatgttaataccggggcattttgatgttgcaataaataagaagaggtttcctaactttttcctgatctagctggtaacatcaggagtcagttcctatcagcatacatctgtgacattggagttcttcgaaactgttgttagatatgaaaagtttttcacagttgaacctcagcacattccatgtgtactaatggctttcttagatcacagaggtctgcggcattccagngcaaaagttcggagcaggacggcttacctgttttctagatttgtcaaatctctcaataagcaaatgaatcctttccttgaggat

SEQ ID NO: 470 - DNA, 593 bp, Homo sapiens
  misc_feature (1)...(593): n = A,T,C or G
gaattcgaacccttcggtattaacaaatatntacatttctatttttataatccataaggatatgcctgttttaaataacatacatattaacaatatctatcaggaaaaccctcaagacagcttctagttaaaaccttngntgctgtcctctcaaactatatttataaaaatttgctagggccaaatccatacttgcagaataattcatcaaattttatttttaagngaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtangatctactgactgtngccatcaccagaacacttagtttcttcccagacatgaatttcctgacaggctctgagccagaaacacactgtgggcgtgcatntgggtcaccctggatatgcctccact

SEQ ID NO: 471 - DNA, 581 bp, Homo sapiens
  misc_feature (1)...(581): n = A,T,C or G
tttttttaatcangggacatttattaacatgcttcaaaagtgaccaaagtgtccagccagcacaatagccgaggcaatcaacgttctcttagtgtgtgatctcgtccaaaacaccaaataaataggtttaggaataacctcaaataaattgtaatttaacttcgcccaaaattatacatcctctactgctcttccctgctcctgtaaagatactagcgggaggggagaaagctcaaatgactctgtaatttagaattacaaccagagaagaaatacttcaagcacaataaagacgttccattgaagagcgacattcattctggaatgtttgttttgaaaacaactcttntgggggaattcaaaaggtactgaacaaagcaacataaagtaagttttgggttgttttgcaaaataaaaatatacaattgagtggaccagatggcaaaaacataccaattacaatctgaatgctatatttaaaacccttaaattctgaaggcctgaatatcaacaaacctatttatgtttatgatcctaaaaagacattaaatattattaaacccccaacttccaaaacatag

SEQ ID NO: 472 - DNA, 674 bp, Homo sapiens
  misc_feature (1)...(674): n = A,T,C or G
gaattcgaaccccttcggatggcgtgatgtntcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaagcccacctgatggagatccaggtgaacggaggcactgtggccgagaagctggactgggccccgcgagangcttgagcacaggtacctgtgaaccaagtgtttgggcaggatgaaaatg

SEQ ID NO: 473 - DNA, 646 bp, Homo sapiens
  misc_feature (1)...(646): n = A,T,C or G
ttttttcagnggaaaataacttttattganaccccaccaactgcaaaatctgttcctggcattaagctccttnttcctttgcaattcggtctttcttcagnggtcccatgaatgctttcttctcctccatggtctggaagcggccatggccaaacttggaggnggtgtcaatgaacttaaggtcaatcttctccanagcccgccgnttcgtctgcaccagcaaggacttgcggagggtgagcacccgcttcttggttcccaccacacagcctttcagcatgacaaagtcattggtcacttcaccatagnggacaaagccacccanagggttgatgctcttgtcanataggtcatagtcagtggaggcattgttcttgatcagcttgccgtccttgataaggtagccctggccaatcttataaatcttcttgttgatctcagtgcggtgatggtagcctttctgcccagcgcgtgccacagagaaggctacacgagcaggatgccatgccccaatacaggccaccttgcgcaggcctcggtgggtcttgcggggcagcttcttggtgtgccaacgactggtgacccctttgtagcctttgcccttggtcaccccgatgacgtcgatcatctcatcctgcccaaacac

SEQ ID NO: 474 - DNA, 544 bp, Homo sapiens
  misc_feature (1)...(544): n = A,T,C or G
gaattcgaaccccttcggcagcacactcccantcggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacaagtactgggcgggtgaaacgattaccacccatagtgcgaggaggagccatcgacagatactggcccaccgncgacgggcgccttggttgaatatgacatagaatgaagtggtatatgacg

SEQ ID NO: 475 - DNA, 578 bp, Homo sapiens
  misc_feature (1)...(578): n = A,T,C or G
gaattcgaaccccttcgggagaaccccatgngggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaaaa

SEQ ID NO: 476 - DNA, 619 bp, Homo sapiens
  misc_feature (1)...(619): n = A,T,C or G
ggaattcgaaccccttcgctcctgcctgtccgccatgttttcaggncgggnctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaattttccgcttctaccttgctggatcttgcgaaacactagt

SEQ ID NO: 477 - DNA, 674 bp, Homo sapiens
gaattcgaaccccttcggggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccacccctagtgtaaaataaaatcaagtaatacat

SEQ ID NO: 478 - DNA, 663 bp, Homo sapiens
  misc_feature (1)...(663): n = A,T,C or G
tttttttaagctttcacaatttttattaaatcctagtctanttgaacaatatctgatgttacagacatcatcccatggtgaacatgtttaataagtgaaagcaagtcagacatctcatctaagtcattattttctgcagactaagcaataactacacagaacactatgggtaaacaaacacctgctcagttttcacacaagccatgttgtttatcaaattagatctgctaatattgaatacagtagattcggtgattgtagttctcatataagtatcttattgagataacattttgacagtttcactgactttccaaataagcataccataatcaaagaaaagaataaagagtgaagtaaaaactgaacatgaagagattaagttattaaaggaaaatgaagtaaataaaaagagtgaaaaaccattgggggtggaagtcaaacaagcctagacatttgattggaagagaaaagatcaaatatgaagttcacaaaccaaaagtttataaactcaatgcaatacaaatcctttttattgtaaaagctgagttgaaactaaaagatctataaaaactgttacttttggccttaaacagtaccaactcttatgatcaaaaaaggccacacagttaagattgnattacttgattttattttacacta

SEQ ID NO: 479 - DNA, 673 bp, Homo sapiens
gaattcgaaccccttcgaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgccttttgtctctaatgagctagatgaccctgatgatc

SEQ ID NO: 480 - DNA, 203 bp, Homo sapiens
  misc_feature (1)...(203): n = A,T,C or G
gaattcgaaccccttcggggggaggaagaggaggtggaggaggagggtgatgttgatagtgatgaagaagaggangaagatgangananctcctcggagggcttggaggctgaggactgggcccagggagtagtggaggccgntggcagcttcggggcttatggtgcccaggaggaagcccantgccctactctgcatttcct

SEQ ID NO: 481 - DNA, 482 bp, Homo sapiens
ccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacagaaaaaaaaaaaaaaaagggcggccgctcgagtctagagggcccgtttaaacccgctgatca

SEQ ID NO: 482 - DNA, 505 bp, Homo sapiens
aaaatctttagctgccaagaaagaagttaagactctcagtgctgagagagactgaatccacctaggtgataaggtgactggacccagtaaaccctttgtgtgctggggggttttatgccttgtagaacccagtgtgagcaagatttgggtaccctacatacattcagtagccaggaaagggtgattggattgccagactctgcctgctggcaaaaggatgagctgtagaagctgaagtcctaggtagtagatataaagaagacaaattaggtggcaccttctagactgtgcaatgcatggatttggaattgaatttttcctctaattattctagggaaaccctgggctaagaaaccaatgtaaaacctgatgaggtagtctgtagtcacactgggtagaggtagaggcaaccacaaaattattcttaagaatgcctcccaggcgcctggaagatgaaactttctggtgaatatgagctcatggtaaaaatttaggtcggatgcag

SEQ ID NO: 483 - DNA, 501 bp, Homo sapiens
tgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctag

SEQ ID NO: 484 - DNA, 501 bp, Homo sapiens
gcactaagaccaccttctatgaggagcagggtgactactacagccagtacatccgggcctgcctggaccacctggcccccgactccaagagttctgggaaggggaagaagcagccttctcttcattacactgctgctcagctcctggaaaagggtgtcttggtggaaattgaagatcttcccgcctctcacttcagaaacgtcatctttgacatcacgccgggagatgaggcaggaaagtttgaagtaaatgccaagttcctgggtgtggacatggagcgatttcagcttcactatcaggatctcctgcagctccagtatgagggtgtggctgtcatgaaactcttcaacaaggccaaagtcaatgtcaaccttctcatcttcctcctcaacaagaagtttttgcggaagtgacagaggcaaagggtgctacccaagcccctcttacctctctggatgctttctttaacactaactcaccactgtgcttccctgcagacac

SEQ ID NO: 485 - DNA, 504 bp, Homo sapiens
cgcactcttggaacattctttctttcaacaacccaaggcatgcttctatctccttttgaggtttccctctaagtgttacctctaagataggcttttcctggacactctatgatggaacctctaggattttctctattgttttatgcttattttgatatttgattcctagaattttaaatacattatatatcatataaaataaacctttaaatattgaaatgaaaagataaaaatacatacactaagtgaataggtcaaaagtgtgagatcatcttgaacattatcttgaagagaagataccaatttaccttctgctcagatcatggtgtacgatatcacaacctgcctagaataactctccttttctgaaccatttattcactacttttgtcttccaattaaatattagcctgacttcaaatatcatacattagtttcctttgtttatgtaattgaattatataacatatattcattagagcctattttttttaaaatttttgt

SEQ ID NO: 486 - DNA, 501 bp, Homo sapiens
gagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacac

SEQ ID NO: 487 - DNA, 501 bp, Homo sapiens
  misc_feature (1)...(501): n = A,T,C or G
accattatttagcagcaaaaaggaaagtttgaagacattaacaggaactggttaattgtagtccttatctgaaaaggacagattgaatgcagccaaattatggcaaagaaatcagtaggacaacccctataaagggtagttcttttaaaaaaaatttctttattggcaacaacataaaagatatgaaagaatcactcataatttatcagcataacatagctattctcatttttgcaattgactttttagttcttgaccaaatgtaatttttattagttgtgattaactgattttgtgctttttttaaaaaaaaaaaaaacctagaataagacatttgttttgttaattattataaatgactgtattcattctgtttatgtaccataattttggatgttcctacgatgttaaacttttaggttgtttttaattgtttgttcttatagacaactctgtaagggnttttaactgcttttatcaggagaatgtcaaagaagtcct

SEQ ID NO: 488 - DNA, 148 bp, Homo sapiens
attctaaggatgaaatggctacagagcaaactgcagctgagagaaaactgcttggagtttggacagaggtggaattgagtgtccacaggccagctgaggaggtggtacccagcactctatgaacccttcgctcaagtcagcctggagt

SEQ ID NO: 489 - DNA, 501 bp, Homo sapiens
gctgtggattcccctccaagtggaggaggatgggcaggctggggatcctggggcaaatctctgctgtcgtcagcatctgccacagtaggtcatggattgacggcagtcaaggaaaaagcaggagccactctacggattcatggtgtaaattctggatcttctgaaggagcccaaccaaatactgaaaacggagtccctgaaataacagatgcagccacagatcagggccctgcagaaagcccacccacttccccttcatcagcctctcggggtatgctgtctgccatcaccaatgtggttcaaaacacaggtaaaagtgtcttaactggaggccttgatgcgttggaattcatcggcaagaaaaccatgaatgtccttgcagaaagtgacccgggctttaagcggaccaagacgctcatggagagaactgtttccttgtctcagatgttaagggaagctaaggagaaggagaagcagagactggcacagcagctcacgatg

SEQ ID NO: 490 - DNA, 482 bp, Homo sapiens
attgcaaactgaaagtggacaaagacttaaggtaaacctgctcctcatggtggaatgcttccaaatgctggaaggaggactttagggcagagttcactaaggaggcttgtgcttatagatcagtgggcctgaaagaagtttctctaggttctggttgtgtgctgtacgaggtgtaggtagtaataatactcttgtcagccacagtgaagccccaagctagccgggataggggactgaccttgtacaggcagcatggagaaactaagacagagtgtcctgcccaagtgatggcactggggagcagtcactcaggtttatttccaccagggcccaagaaaaaaagaaatgaggcaacctaaaattccatcaagatagataccaatatccaaggtgcttggtcttagcggtgtgggacccacgttaaggctcttggtgggaaggtgggaggtgttttcagcatgagatagggttcaggctgtgaa

SEQ ID NO: 491 - DNA, 483 bp, Homo sapiens
cgcctctccccgtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctccccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcag

SEQ ID NO: 492 - DNA, 266 bp, Homo sapiens
acctcatctgctttgctttggcatgtgagccttgcctaagggggcatatctgggtccctagaaggccctagatgtggggcttctagattaccccctcctcctgccatacccgcacatgacaatggaccaaatgtgccacacgctcgctcttttttacacccagtgcctctgactctgtccccatgggctggtctccaaagctctttccattgcccagggagggaaggttctgagcaataaagtttcttagatcaatcaaaaaaaaa

SEQ ID NO: 493 - DNA, 483 bp, Homo sapiens
gccgctcgcgctaggagagcgggcttcgggcacttgacatggcggcagtggcggcgactgcagcagcgaaggggaatgggggcggcggtggcagggccggggccggggacgccagcggcacgcggaagaagaagggcccggggcccctggccacggcgtacctggtcatctacaatgtggtgatgacagccgggtggctggttatagcggttggtctggtccgagcatacctggctaagggtagctaccatagcctttattattcaattgaaaagcctttgaaattctttcaaactggagccttattggagattttacattgtgctataggaattgttccatcttctgttgtcctgacttctttccaggtgatgtcaagagtttttctaatatgggcagtaacacatagcgtcaaagaggtacagagtgaagacagtgtcctcctgtttgttattgcatggacgatcacggaaatcatccgtt

SEQ ID NO: 494 - DNA, 301 bp, Homo sapiens
gtggctattttcatggaatatcttttatcagcctttcagttttaatttatttgtgtctttggatctaaagtcagtttgttttggacaatgtgtagtttgatcatgattttaaaaaatctattctgaagctgggtggttcacacctgtaatcccagcactttgggaggatctcttgagcccaggagttggagactagcctggtctacaaagtgagactctgtttctacaaaaaaataaaataaatagttgggtgtggtggtatgcgcttgtggttccagctacttgggaggatgagggagga

SEQ ID NO: 495 - DNA, 496 bp, Homo sapiens
cgaagtgaaggctaggggcccgtacgcgcccgcctgactgtcgccagcagctcctcggcggccccaccgcagccgccgctccctgaggcgcgggaggcccgcgccccgcggctcgctgtgcgtgggagggcgcgagcgaacgcgggcgaggagcggccgagccgctgaagaggagctgggcgccggccgcccggccgcgctcggcccgcggatcgcctccgcccggtcttcgccggccccggcccctggcgagatgccgtgtggggaggattggctcagccacccgctgggaatcgtgcagggattcttcgcccaaaatggagttaatcctgactgggagaagaaagtaattgagtattttaaggaaaagctgaaggaaaataatgctcctaagtgggtaccatcactgaacgaagttccccttcattatttgaaacctaatagttttgtgaaatttcgttgcatgattcaggatatgtttgaccctgagttttac

SEQ ID NO: 496 - DNA, 494 bp, Homo sapiens
aaactatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagtt

SEQ ID NO: 497 - DNA, 184 bp, Homo sapiens
gcgcgccgcggctggcagggtgtgcgtgagtttggtggcggccggctgtgcagagacgccatgtaccggctcctgtcagcagtgactgcccgggctgccgcccccgggggcttggcctcaagctgcggacgacgcggggtccatcagcgcgccgggctgccgcctctcggccacggctgggtcg

SEQ ID NO: 498 - DNA, 471 bp, Homo sapiens
tcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcata

SEQ ID NO: 499 - DNA, 478 bp, Homo sapiens
aggtgggaaaagcggaggaggacgcccaggaggaggcggcggcggcggccgggaagtgaaaggtctcgcaaagttcagcggcggctgcgggcgccgagccccgggctagcggcagacgagcccgcagggccgctccgcggggcagcgcagccaggccggctatggtcccggggctcccgccgccccccaggtgcccgggacccgccaggccggtgcgcgagggtcaccccacctccccgcgcggtcccggcccctggctcccagctgccggcgaccgctgaccgagcccggcgccccaggaggaggaagaaaccagggccccgttccctcccgaggacggcggcgcttcatcccgcagcccagaggtctcggctccctccggcacccgcccggcccggctgctcccggctcctcccggccatggggagctgcgcgcggctgctgctgctctggggctgcacggtggtggccgcaagga

SEQ ID NO: 500 - DNA, 495 bp, Homo sapiens
gggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcgtcctcttcctgcccctgctcctgctgctcggggagcttcaggccctgcgtgactttgcccagctgggcagtgcccacttctgggggatgatgacgctgggcggcctgtttggctttgccatcggctacgtgacaggactgcagatcaagttcaccagtccgctgacccacaatgtgtcgggcacggccaaggcctgtgcccagacagtgctggccgtgctctactacgaggagaccaagagcttcctctggtggacgagcaacatgatggtgctgggcggctcctccgcctacacctgggtcaggggctgg

SEQ ID NO: 501 - DNA, 494 bp, Homo sapiens
ctgcggtgtggttggtggtgagatgacgaccttagtgctggataatggagcttacaacgccaaaatcgttacagccatgaaaatgtgtcggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaagtttgggattacctttttggaaaagaaatgtatcaggttgattttttagatactaatattattatcactgaaccatactttaacttcacttcaattcaagaatcaatgaatgaaattctatttgaagaataccagtttcaagcagtattaagagtaaatgctggggctctcagtgcacataggtatttccgagataatccttccgaattatgctgtatcattgttgatagtggatattcctttacacatatagt

SEQ ID NO: 502 - DNA, 479 bp, Homo sapiens
ttgtataatgctgaatgtgtccagagggacaagtttgcagaacctcatattggtatattaaagaaataataaaataaaaaagcactttaggttattttatctttaacccgattgctgcaatttcttttgtgtgtatatatacatatatatactttccacaaagttttattttttgctcagaataaaaagttaaattgaggtgtgaaaagaaaagcacttaccttggtgcaatatgtgtagcttgatggtcgttgtcccatgtggccctggcctggcagcgtttttccgctcaatcagccctgtgctgtgagattgtccatagggaaacactattatgcattctcagcaaccgctcaatctatgcaagccttccctgtgtgccccagggcgccccctcaggctctctgaagaactgctgtgggtcctgttttctgctgactgttgaggccctttttcatcacttcttggtctctcgccat

SEQ ID NO: 503 - DNA, 451 bp, Homo sapiens
ttgtgggccgggtgggtttcctaatctggtttcgtctgcctggttcatctgtgtgcgatggctccggactcggatcccttccctgaagggccgctcttaaagctgctacccttagacgctagagaccggggcacccagcgctgccgcctgggcccggccgccctccacgccctgggcgcgcgcttgggctcggcagtgaagatctcgctacccgacggcggctcctgcctctgcactgcctggcctcggcgggacggagcggacggctttgtgcagctggacccgctgtgcgcgagccccggggcggcggtcggggcgtcgagatcccggaggagtctcagcctgaatcgcctcctcctagtgccctgtccgcccctgcggcgcgtcgccgtgtggccggtgttgcgagagcgggcaggcgcgcccggtgcccggaatacagccgcggtgc

SEQ ID NO: 504 - DNA, 462 bp, Homo sapiens
cagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatt

SEQ ID NO: 505 - DNA, 136 bp, Homo sapiens
tcgattatatcacacatttcagttgggaggttgtctcaacctgtgaccaccatctgagttagctggcagacttctaggaggtcctgtctgaggtagaatcagaaatggcttccctccttctcccataaaaaaaaaa

SEQ ID NO: 506 - DNA, 466 bp, Homo sapiens
ggggtacagagacagcagcctgcggagcgttctaggcaggacagggcagcaaacctgacatgcggagctgggggcaggggtaatggggccagggggtaatggcaggtgaggccatggcctagagggttgccatgcttggtgcaggggaggagaggcccaggtgtggctgcagtggcagcaggagtcagtgtggctgtgcccagtgggatgttgtcagagaatggacctggctgctgggaaaggtgattgtgtttgtctgagccacactggactcttctctgaccagcaagcacattctggagatgcggggcagagacgaggcctccgtgagaacctttgaggtgtgagggccttgatctggggtgcagcctccagctttctgcttacagagcaggacctgcaggagctcgctgactgcctgcacagtggaaggaagacctgtttcttttactttccttgaggagaa

SEQ ID NO: 507 - DNA, 101 bp, Homo sapiens
atgatttaattttttaaactgtagcaattggatagataattttatttgaaattttacacactgaaagctctaaataaacagatacattcacattcaaaaaa

SEQ ID NO: 508 - DNA, 242 bp, Homo sapiens
gacaatgcaagtaacctcaaatgagagtgtggaaaggcgggaaagcagccagagcttcattgttatgaaaaaagagtgaaatgtgctctgttgaagagttgaagaatgaacaaaggatatttagtttgaatggaagctcagtaatgagaaatgagaatggttgagttcttaaaagaagcaagtaaagaagaggatttgtgggctactattctcattcagtgaatctcatwccacccttgcct

SEQ ID NO: 509 - DNA, 101 bp, Homo sapiens
cctttgctccctttttccaatttcttattgcatatctttctgtattacaacaaaatgatatgcaataagaaattggaaaaagggagcaaaggcgaaggggy

SEQ ID NO: 510 - DNA, 461 bp, Homo sapiens
gcaggttcgggaccatgagttggattccttttaagattgggcagcccaagaaacagattgtgcccaaaacagtggagagagactttgaaagggagtatggaaaacttcagcaccatgtcaaaatctgccgtgaagatatccttggacttactctccaatcccctctgtgagcaagaccaggaccttctgaacatggtgacggccctggacacggccatgaagcggatggatgccttcaatcaggaaaaggtgaaccagatccagaagactgtgatcgagcccttaaaaaagttcggcagtgtcttcccgagcctcaacatggctgtgaagaggcgggaacaggccttgcaggactacaggaggctgcaggccaaggtggagaagtatgaggaaaaggagaagacggggccagtgctggccaagctccaccaggcacgagaggagctgcggcctgtgcggga

SEQ ID NO: 511 - DNA, 461 bp, Homo sapiens
ggctttctgatatttctaaaattgacctggaatcaaccattgacatgtcctgtgctaaatatgaattcactgatgccctgctgtgccatgatgatgagctggaagggcgccggattgccttcatcctgtacctggttcctccctgggacaggagcatgggtggtaccctggacctgtacagcattgatgaacactttcagccgaagcagattgtcaagtctcttatcccttcgtggaacaaactggttttctttgaagtatctcctgtgtcctttcaccaggtgtctgaagtgctgtctgaagaaaagtcacgtttgtctataagtggctggtttcatggtccatcattgactcggcctcccaactactttgaaccccccatacctcggagccctcacatcccacaagatcatgagattttgtatgattggatcaaccctacttatctggacatggattac

SEQ ID NO: 512 - DNA, 686 bp, Homo sapiens
  misc_feature (1)...(686): n = A,T,C or G
actgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacctcgccgcgaccacgctggaattccggaagggcctgtcctangatccagtgtggtggaattctgcagatatccagcacagtggcggncgctcgagtctaaanggcccgtttaacccgctgatca

SEQ ID NO: 513 - DNA, 429 bp, Homo sapiens
catgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtgg

SEQ ID NO: 514 - DNA, 346 bp, Homo sapiens
  misc_feature (1)...(346): n = A,T,C or G
aaaactttctctacttatttagttttntcctctgagttcaaccgctgctggattcgtttggcataactttgtgccatggagttaatgatagataggatgaagtaacacaccatgacaacgaccaacttttcaaacatccaggacaaccagttttctccctgtggtgtgcccatttcgcttttgtggtgaagcttctgccgttgagcctccaggtactcctgaaatggcttctgcagagatggacctatgccggggacagcactggaagcagggtacagtagcccaaagaaaaagacacatttgggaagaaaagcaggaaaaacgttaaagaaaatgtacttaccac

SEQ ID NO: 515 - DNA, 549 bp, Homo sapiens
ctgaccaggactgtgaagatgcggttccgctgcgaagatggggagacattttccaggaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatggaactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagttt

SEQ ID NO: 516 - DNA, 382 bp, Homo sapiens
ccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatactccttgaagtagatgtggatgactgtcaggatgttgcctcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattggctattt

SEQ ID NO: 517 - DNA, 323 bp, Homo sapiens
  misc_feature (1)...(323): n = A,T,C or G
acgagcgtaggacgatgcttctcttntgtcagcctgcaactgagtcaggattgaatacttggaccccaggtctggagattgggatactgtaatgcttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagt

SEQ ID NO: 518 - DNA, 605 bp, Homo sapiens
ctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattggtttggtttttt

SEQ ID NO: 519 - DNA, 462 bp, Homo sapiens
  misc_feature (1)...(462): n = A,T,C or G
ctgctggtcatgnccttggcagtcttttgtgcaaaataaggcatattngagctccacattaaccttgcggcaggcgnctacttgctctgcatgctgtancagngcacgtcctccttccccttggtggtgtagcctgnganaggctgcccatacttatccacacaccagcanaagccccgcttcctgcctttggaagggcgacactgctttttcttataaaatcccttcttgtcacagttgggaatgtgnacacccctgggactcagcacattgaggaacttcaagtgattcagtgtgncttccatttctctacggcangnaccatattctgtctcccgcttggactcggaggagaagttctgggtatctgtgctctgagactcgtagtcaactttgtagcgctggctgnctttagcatgccctttcttgatgatgantatctttgaatggagggggtggaac

SEQ ID NO: 520 - DNA, 565 bp, Homo sapiens
actcgtaataaatatgcatccggaaacaagataaaaggctacacctcgtcaggcatcctacaaaaatgtctcaagttttatatactctgcagcatttctgtgcgggggcagaaggggctgttgtgtattttctgaagtgctgtgacaaaaggtcctttcacatttctttggagcatttttgaaattgcttaactataattaaacaacttaagaaaagtaacaccaagctttaaagccatttttgctttgctgtcattggtccttatccaatacagatcaacatatcatccagcacagccaagcacccactgaggccaagcagccttgtgggacatgggccctgtcagagcaggccctactttcagttaaatactttggagagtccaggattctgtctctctccctcaacaagattaatgccataagggaagttgcaagcgtgttagaaacatttttaacctgaaagtaaagtgaacagaaatatttttttttccgagacctctgctatgcaccataatattaccatatcagggtttttagcttcaaagttgaaaaacagattggt

SEQ ID NO: 521 - DNA, 127 bp, Homo sapiens
acatggctgacgtcaccgtccagtgcaaaatcaaaaaagaaagaaagaaaaaccccaaagaaagaggatttttcagtggagaacatggtgggctgattaggcttctattagattacattcatttcac

SEQ ID NO: 522 - DNA, 642 bp, Homo sapiens
  misc_feature (1)...(642): n = A,T,C or G
actatgtttcgtaaattaaataggtntggcccagaagacccactcaattgcctttgagattaaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagcaaaaatttattaaaactgaataaagtgctgttcttaagtgcttgaaagacgtaaaccaaagtgcactttatctcatttatcttatggnggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgc

SEQ ID NO: 523 - DNA, 244 bp, Homo sapiens
ctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggggacaccctctgggggtcctctctgagtcaaatccagtggtgggtaattgt

SEQ ID NO: 524 - DNA, 407 bp, Homo sapiens
  misc_feature (1)...(407): n = A,T,C or G
acgttagtggtgatgtcacccaccctnnngctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggt

SEQ ID NO: 525 - DNA, 276 bp, Homo sapiens
  misc_feature (1)...(276): n = A,T,C or G
acacaggaggcaacgtgtttcacatnatagacttcacttccaactccttggaatgttcatttctttggcttacaggagagactagacaggaaggccaggcaatgcttaggcaactaaaatgaggttgggggtaatgctaacgtcaccctcacagggatggccacggggactgttattcgcaagctggttttctagacctgttagctggaagcatggtgagcaccatttctggacgctcaggccgtgtcgggcttcagtcatctccaccacacaggt

SEQ ID NO: 526 - DNA, 288 bp, Homo sapiens
acaattacccaccactggatttgactcagagaggacccccagagggtgtctccatcttccctatttattttcagcccttgagggcttcattgtagatcaaagccaaggcccccaggaaggtgacatactcctggaagttcacctcctggtccttgttccggtccaagtcttccatcagccttgcaatttcagcatcctgcagcttcgagccaatggtgagctccttctggatcagctccttcagctccttcttgctcagggtgtgcttgtcaccctccctgccggagt

SEQ ID NO: 527 - DNA, 412 bp, Homo sapiens
actttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcggaccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtgtaaaaaaa

SEQ ID NO: 528 - DNA, 489 bp, Homo sapiens
aaatgcaaaaagtcaaagtaggtaacaggttggtaattaaagtgtcaggaagactggaagaggcaaaaatcaagcagagttccaataagtgtatgaaaaaaaaaatcataactgaaggtttaagaaaagtccccaaaggcagaatcacaatatgagcaggaggaataaaaagcttttggatataccaggcagctttctgtacgactcaggtttacaggtgaaattcctcagtttgagttcagaagaatttgaacttattccagcaaaatacttcaatctttttattactgcctcctcccccatcttctttctgggcaaagggatgcttggattaggtccaaagctcctggcagggggaggggccatgtgtcacagcataacagacggttgcaagtgctttactgagcaggggtcaggtttgcagcaactctgataggctcacacaatggcctccattttacagcccctccttggaggcccactgatcag

SEQ ID NO: 529 - DNA, 631 bp, Homo sapiens
  misc_feature (1)...(631): n = A,T,C or G
acttgcctaaagtttttatatctgnntcttctgctgtaaatcttcccttcataaatgaaaattttaataaaatcaactatgtggaaatatataattaaaggaattcactaactgtgattttcataatttagggacattctcttctagtaagcatggtgcattatttactagagatataatatgcattaaaacaaaaaatgttttctatcatcatagaaaagtttgaggtccagggataatcatctctggatacattatttcctaccgtcgtggtacacactgaacacatttgaggcttatgactggttcttttacttacaaatattgtttagacacattttcaaatgtcacaccaatcaataataataaggaatggattttatctatattgacagttctttcaaccttaagagtgaactgctacaggtaagattcaatcacatttttcaggagaaagctattgagaccaatatgctttggttatctaataggggtggaatgacttataatgctatttactccaggcaaagagaaaatacaacagacataggatcttgatttcaacgtagttctcctccatgtgcatttctctgtccgtttaggcaatgccaactggtccaccagtgaacat

SEQ ID NO: 530 - DNA, 316 bp, Homo sapiens
  misc_feature (1)...(316): n = A,T,C or G
acacatttaaatgactcacgagantnaagtttttttcaaatatattaagatcacaccaccttgttgtttatcgaaagatattcaaggagaaagatctgactctccaaactgcatctgagattgccactttaaacagacctcatttcaaacatgcaacaacgccactggtaataaagctttggaatgggtgctcattctattatttcactacaaacagcatagaaagcaagagaagttgggaatttattctaaaatagaatggaggttgtcatctacagcagcactcctcactcctctgttgccatttttagcaagt

SEQ ID NO: 531 - DNA, 296 bp, Homo sapiens
  misc_feature (1)...(296): n = A,T,C or G
aaagtatcatttatttgaaaaacatacattatcattntgtttttgatatttgataatgaaaaaaatctttgnttgtttatttctgaaaaagaactgtatttagngattattttagatagtgatattatancattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacattt

SEQ ID NO: 532 - DNA, 266 bp, Homo sapiens
acatatgcaccaaattccattttagaagtttccatatcattttcatagaaaacaaagtttgaaaacaagtaacatttaaacacagcacggtattctaccacaactgaaacttttttcttcttcttctttacaggactcaacaaaatctaaaaatgaactatgctgtagatttacctcatgcaaagatctttatgttatctctgaaaatgaaaaggatggccttttaagcacattttactgttttatactattatggcaacttgtgt

SEQ ID NO: 533 - DNA, 289 bp, Homo sapiens
  misc_feature (1)...(289): n = A,T,C or G
actcagaagtcacttttaatatcancgacagaaatatttcactaattcaactgaggcaaatttcctttctagacaaaggacctagaaattgagcatgcaaaacatccatccattcattcattcaaataattagccaattttaccgtcatttaattccaccagaagcaaatactagaatatctagaagtagtttgggtaaagaaacatttacattttaatattgtgtaatgtcataaatttggggctaaaataacaccaggtcaaatttgatccctttgtatgtgagggt

SEQ ID NO: 534 - DNA, 293 bp, Homo sapiens
  misc_feature (1)...(293): n = A,T,C or G
aaaataaaaggttctttacaagatgataccttaattacactcccgcaacacagccattattttattgtctanctccagttatctgtattttatgtaatgtaattgacaggatggctgctgcagaatgctggttgacacagggattattatactgctatttttccctgaatttttttcctttgaattccaactgtggaccttttatatgtgccttcactttagctgtttgccttaatctctacagccttgctctccggggnggttaataaaatgcaacacttggcatttttatg

SEQ ID NO: 535 - DNA, 408 bp, Homo sapiens
acttgaacacttaaagagaaaaactctaaataaagtcatagaggggatggtagagatgaccacagaaaatgaccacggagagtattatgaagattgcaagattagacattgatgatgtaaattactccctttctagataaaataatccatagatgtttatgaatcatatttgtatgattattgctgttactattattttgacacattatttattattattgttgtcactattattaccattaagatagcaggcgtaaaactgtactggttccttcagtagtgagtatttctcatagtgcagctttatttatctccaggatgtttttgtggctgtatttgattgatatgtgcttcttctgattcttgctaatttccaaccatattgaataaatgtgatcaagacaaaaa

SEQ ID NO: 536 - DNA, 184 bp, Homo sapiens
acctctcatcaaggctctgcctacaggcacattgtgatgtatctctgcactgatcacctaggtcatgtaacttttttctaggctctacctacgatggcattgtgacataactctgcactaatcatccacgtgatgtaactcttgtctaggatgtgcctaaattaactttttgacgtaaccctgt

SEQ ID NO: 537 - DNA, 311 bp, Homo sapiens
  misc_feature (1)...(311): n = A,T,C or G
ccacagttgtatcatatagcatctntaacatttcatctaggattatctagtatagatcttactatatttggggctatgttgtatacaatgttaacaagaacatatcttctctgcatatatgtgtgaattataaagaaaagcatgagaatgactctaagttcaacaaacatgggtgaatctctatgtgctcccagtgtcctggatgggctccccagcaagccattcctccttcctgttctgatattactattcttttttacattgtgctaaggaggacaaaaggtgagagatgaaaataaagccttgccttt

SEQ ID NO: 538 - DNA, 302 bp, Homo sapiens
aaaataaaaaagcaaaaactcttgtggtacctagtcagatggtagacgagctgtctgctgccgcaggagcacctctatacaggacttagaagtagtatgttattcctggttaagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcattcatttcttttatacctttcctttttgggg

SEQ ID NO: 539 - DNA, 396 bp, Homo sapiens
actgtttatttgctccttctcttcatgcctgtggctggatgtcccacaacactataagaaatataagtcaagccctttgtgttaagcaagaactacagactccatcttttcacccaaatcatgaatgaccaataaaaagcaagttattccagaggaagaagcagcccttgaaatgttaaggcttaggcttgaaaggtgaagagcaggaattctctctttcaaatcctagagcataaacccatgtgtggccaagtgagatcagccctcaagggcacatgccaagggcagagcagcccatgtagacagcttcggagggcatgggggtgtagggagttcggggtagctcctcattaactatttgttgggtgagtaaaggggtgaggctcagtggcaggt

SEQ ID NO: 540 - DNA, 634 bp, Homo sapiens
  misc_feature (1)...(634): n = A,T,C or G
ccaaaaacaagatgaccagatttgntttnagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgcctta

SEQ ID NO: 541 - DNA, 221 bp, Homo sapiens
cacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggt

SEQ ID NO: 542 - DNA, 287 bp, Homo sapiens
cctcttctactatggcaggagatgtggcgtgctgttgcaaagttttcacgtcatcgtttcctggctagttcatttcattaagtggctacatcctaacatatgcatttggtcaaggttgcagaagaggactgaagattgactgccaagctagtttgggtgaagttcactccagcaagtctcaggccacaatggggtggtttggtttggtttccttttaactttccttttgttatttgcttttctcctccacctgtgtggtatattttttaagcagaattttatttttt

SEQ ID NO: 543 - DNA, 274 bp, Homo sapiens
acttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagataaaaaa

SEQ ID NO: 544 - DNA, 307 bp, Homo sapiens
ccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtgg

SEQ ID NO: 545 - DNA, 570 bp, Homo sapiens
  misc_feature (1)...(570): n = A,T,C or G
accttagaaatttgcaaccacctccctgaaagtcttctcccacgttattaagtgcaatgtttatggtaaatgtagaagcatcatgatgaggacgaagagaacgctgtcgttcaggggagtattttactacaaaattcagtagtgcaaatcccttcgtataatagcctgcaaagaccttcagtgtaactggngcaatgaactcccggataaaatgaagccatacattctccagatcaacttgcttcatgtggatatcatcagttgggacattttcataaccaccagatatacggctatcatgatgttttcccccagaccatttgccgtaatgttccatttcttctaccaattcatcacaggctttttcagaaaatatggggaaccaaaagacatctggacagggctgttcaactatattttcagtgaaaatctttgaataatcacggtttatatacttttccttccagtccacaggattttcaaaaatctgccagaggtcattgttataatgggaagtattgtaattagcagtggataatagccttccaaattcatgtctattagaaatgt

SEQ ID NO: 546 - DNA, 589 bp, Homo sapiens
  misc_feature (1)...(589): n = A,T,C or G
aaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttccttcagtggagcttggtaaaaatgcactaccntttgatttgataaggtataaatct

SEQ ID NO: 547 - DNA, 293 bp, Homo sapiens
actcctattattgactgtagtcaatcaaacataaaaaggtgaaagtaaaatttaattttttacccttattttactgaccaatatggaagttcttggtatctttaaggctgaccttcctggtattgtgtaatgattgaatgtatctaaactgtaataatttgaaactgacaaacataaccttctcagacttacaaaactatgttctttctaaagatacagatttttattattttattttgactaggaaggatttataaataaatgtaatgaaaaatctttgatcttaataaagt

SEQ ID NO: 548 - DNA, 98 bp, Homo sapiens
aaacaaaggttgagatgtaaaaggtattaaattgatgttgctggactgtcatagaaattacacccaaagaggtatttatctttacttttttttgtaca

SEQ ID NO: 549 - DNA, 121 bp, Homo sapiens
acatgcatatttcaaagacctgttaatggcgtccactttggattcttacatgaaacgattcagtgcacattgtaagcctaaggaccacgcaaaagggtttcccacatattaagtattcagt

SEQ ID NO: 550 - DNA, 509 bp, Homo sapiens
acaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaacaaaagcacacaacgattatagtaactataagatacaataaaacaaataaatgtgaaagtagattcatgaaaatgtattcctttaaaatattgttttcctacaggcctatttaacaagatgtttcattttactgtatattttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgt

SEQ ID NO: 551 - DNA, 427 bp, Homo sapiens
accatggttatatgattaatcttgggacaaagaattttatagaaatttttaaacatctggaaaagaagcttaagttttatcatccttttttttctcgtgaattcttaaaggattatgctttaatgctgttatctatcttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaaataatgaaacacagtgaatttgtagagtgggggtatttgacatattttacagggtggagtgc

SEQ ID NO: 552 - DNA, 340 bp, Homo sapiens
cctcaaggcggtccaattatccacttgcagattctacagaaagagtgtttcaaaactgctctgtcaagagaaatggtccaccgtgtgtgtggaatgcagccatcacacattagtttctgagattgcttctgtcttggttttatggggagatatttccatttctagcataggcttcaaggcgctctaaatatccgcttggaaatactacaaaaacagtgtttcaaaactgctgtatccaaaggaaggtgccactcgctgagttgaatgcacacatcacaaggaagtttctgagaattcttctgtctagattcatacgaagaaatcccgtttccaacgaagg

SEQ ID NO: 553 - DNA, 549 bp, Homo sapiens
acttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatacttttt

SEQ ID NO: 554 - DNA, 321 bp, Homo sapiens
acctaataatatgttaacataaacataacaacacacatattatttttctaccccttggcaactgaaaatgaagttaccattcctaggccaaatttttagacaaagctttctaaaaccatctttataaagtaaattcagatatgcttacaataaaaagacataaaagattcatcctgagatgaattctgagtcaataactaaaaaccatttctaccagtgcatcactaccatgtaatccattctacgcaagctctacaaatattgagtcaaatcctgtctgtcagaaaatgaagacccaataagtttgccgaagtattcagt

SEQ ID NO: 555 - DNA, 322 bp, Homo sapiens
ctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaaacttt

SEQ ID NO: 556 - DNA, 286 bp, Homo sapiens
aaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctcttt

SEQ ID NO: 557 - DNA, 459 bp, Homo sapiens
acagaagatgaataataatgaaaaactgtgattttttgactatcacatacattgtgttaaaaaacaggtaaatataatgactattactgttaagaaagacaaggaggaaaactgtttcaatgttcaggtttaaatactaagcacaaaaatataacaaattctgtgtctacaataatttttgaagtgtatacaagtgcattgcaaatgagctctttaaaatttaaagtccatttcccctttagccaagcatatgtctacatttatgatttctttctcttattttaaagtctcttctggtttagttttttaaaaagtttcatcatggctgtcatcttggaatctagcctccagctcaaagctgagacttcacgcatacatattctcctttctgggtgcatcttcacctagtttctccaagtattcagagttaaatagcacaacttcttttatatgttccct

SEQ ID NO: 558 - DNA, 303 bp, Homo sapiens
  misc_feature (1)...(303): n = A,T,C or G
aaaaaataaaaaacaagacaacaatttagtagaagtaccnctgggagggaggggaggggaaaaaaggatatacaggggcaggngtattctctgtacagaggtgcananaaaatttcacatanctttanagaatgccttgtggaaaaaaaaaaataggccccaatacttgttactgccctttatcaaaactgtgtgcatgacctgcacaaataaaatcacaaaacagtgttgccacattcttcaaggaaacaaagcaaaatttagggggnttcttttccctctccttgttaaaagtcatttttt

SEQ ID NO: 559 - DNA, 232 bp, Homo sapiens
  misc_feature (1)...(232): n = A,T,C or G
aaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaaagagagagtgtgtgattagaagctaaataggaaagttttgagcttcaagtcagngaggagtaaaaaagattttt

SEQ ID NO: 560 - DNA, 336 bp, Homo sapiens
  misc_feature (1)...(336): n = A,T,C or G
ctctgcaaaaataannataaaaaaataaataaaattttaaaaataataaaattcactatatacacatataaagaaataaaaagaagtctcagttgcagctatttgtcaaaattaatatccatttctttttatatacggtgaatattgcgcaattatagatctggattttgaaccacttaatgaagcggcaacaccaggtgttttgaggtgttggcattcttcgctgatttggctgttcccaatgtttacattatttaatcttgcaaaaatggttctgtgcacttggatgngaaatgctgnccagntttattttttttatgttgntatccttggatg

SEQ ID NO: 561 - DNA, 636 bp, Homo sapiens
  misc_feature (1)...(636): n = A,T,C or G
acattatgggttttattgctttcttttatggtagacctgttaatggggaaaaaatacatcaaatcaaatagaatcttatatctgtatgttaaaatagagcacttacctgaagtcagtggcctggatcatagccctggatcatttcccagtctgtcctgtgctgtgtgaccttggacaaggcgcttcatctctctgggcctctatttctccatttgtaaaacaagtggctgcagtagatgatggctgagagcccttcctgttcccagatgccttggtccaaagaccccacccctctgctggtcctgccaacgtgttggtgctataagctgcttcagatataaaattggtttatctataatgtttgttcatttaatagcttctaaaaggcctttttgttatacagtgctttttttctagttttatggacttggttactgtaataatgtcttgtttttagccatgtaactacaaacagatattctcttgatgtcttagtaaatttgcatttgatatatcattgatgagattttgttgttatgtaatattctttggctacgcatctgtccagcatcttattaaccataatactgngatcattatttggaaatatgtcctatggaaagaataaaagcatgt

SEQ ID NO: 562 - DNA, 708 bp, Homo sapiens
  misc_feature (1)...(708): n = A,T,C or G
acagtccaccttttgatacatgccatgcctttgatcaaagaacaggacataaaaacaaagtcacaatgacattccatagtaaatttggaatcagaactccaaatgcaacttcgggctcgctggagaacaactaaggggcaccaaaccctctgaggttttactttaaggttcgctgtatgtttgccttggacaaaaaggctacctaccacgtgctatccagtaatatacttaaataagccaatacttagatctactgtaaggcagatgctaattataaggcattaagtaagcaaatagtgccctcagctactgcagaagaaaagtcccactgaggaaaagaaagtcttgtgatttttaaaggcaagttttcaagtgctctcatagttctatcctctaattccattaaatccatactaggagcgtcagtgagggttttcatagcttttggaaatactttggtctctgaactgtaattagcaagaagtaaaaacagaaacgtcaaacgtcaaatgtttgctttgttacctggaggactaaatgtagatgtctttagtatactttgtatgttcttaatattggaagataattttgtgaatctgtagattttattttttcagtcttaccttacaaatttcttttctatgaataatagaggacttacngcactctgccatttgttaatgaaaggaaggcngangatttagaaag

SEQ ID NO: 563 - DNA, 290 bp, Homo sapiens
ccagatgctcatccactttcagactttcatctcttctgccatctgccaaagtcaacagagctttccggaagtcaccagatgtttcggaactaatgtcatctccaagactcttcttgtatactgtataataggcttgagagatatccttcatttgcctgcttgtcctggtagttaagatttcaatcaaggcatcttcgtttgttcccgcgcccttcatggatttctttagctgctttgcatcaaagactgctggtggagtcactagggccaccatgagatgctcaaagtgg

SEQ ID NO: 564 - DNA, 530 bp, Homo sapiens
accaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtcgatagcgctcacgcaagcatggttaacgtccctaaaacccgccggactttctgtaagaagtgtggcaagcaccaaccccataaagtgacacagt

SEQ ID NO: 565 - DNA, 450 bp, Homo sapiens
  misc_feature (1)...(450): n = A,T,C or G
ctgcttacggaagcgctgnntgactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcc

SEQ ID NO: 566 - DNA, 563 bp, Homo sapiens
acttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaaaaaaaaa

SEQ ID NO: 567 - DNA, 424 bp, Homo sapiens
  misc_feature (1)...(424): n = A,T,C or G
ccagtgagcaaattgaaaaccaactgaaagcaaatccaaatgaggaagattttaataaaggaatacccttctccatagcaggtgcaatgctgactgctcaaggcgtgcgtgcgcgcgcacacacacacacacacacacacatacatactctcacacacncatctttccaattaaactgcaggtagaatgagattttgtgttattcaaaaaatttgtaagtgatcaaaancactgctatggaatgcctgtttatctgcctttgntctggttaaaatctcataaaaatacattcaacaggaaaacatanattgtatgtgtataaatatatatgtatatatatatattatatacacatgcacacaaatacttttgttttttgaagcataagatagttacataaatactcctataattgctaaagttt

SEQ ID NO: 568 - DNA, 392 bp, Homo sapiens
  misc_feature (1)...(392): n = A,T,C or G
actggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtgggttgancaaaagaaagcttggaagccncaagaaccttgtgatattccagttccccctgcantgggtttgggaagtccctgccnttttgaaagctggtttgaagcgaatgttcataggaaagtttgcttaccacttaccctgcccatggtangacaaaag

SEQ ID NO: 569 - DNA, 559 bp, Homo sapiens
aaagagatttattaaatcatcttatcacaaagatggaaacatatacaaactagaaacatgcaaccatcatcttccacagtcaagtcacaatgtcaaatatttttcttgcctctgcagatgaaaagttcagatcttatacccaactacttactcaccccgaatatttaagtcagtcttcctgaaagtactcagggtagcaagtaacaaaatgcaaacgattatataaagaaagtgcagttaaaaaggaaactatgtggcaagtaccctctttcccttcccaccccccaattaaaggcaaacaatggcactttgctcttgcttaacctagattgtcttcaaaaactattaaaatgtaaaagacttaacaaaaaaacaaaaagacgtttaacagatgtcaaaaagctccttagtgtttgaaaataaatgcttaaacaaaagacaacatattttatatcaaacaagtttgaagagccctgaattgcagcattctgtaacataaacaaacaaaaagctggtataggatttattggcaaaggcagaatttcttcaagcagggtaa

SEQ ID NO: 570 - DNA, 368 bp, Homo sapiens
agccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccattttttt

SEQ ID NO: 571 - DNA, 261 bp, Homo sapiens
acacgattgctgcttccgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggctggtggggaggggtgctctgctggtcttcaattaccaagaattctccaaaacaattttctgcaggatgattgt

SEQ ID NO: 572 - DNA, 488 bp, Homo sapiens
ctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgt

SEQ ID NO: 573 - DNA, 619 bp, Homo sapiens
  misc_feature (1)...(619): n = A,T,C or G
actttactgaaagaacactantgttctttcctttccgttgtgaaaaaagttgtttctgaggaattgaaaccccagaagataactacaacaaaaacatgttaatttttttttaaaaatgatgattcaaaggcagatttgaagggaagtaatatttaggtggcagaagaaggcaaatgcagcctctgaagggaactgttctaattattacctaaaaaataaagttacacaactatattcaaggacatgagataaagcactgcttgaaaaccagaatgactgaacagttaggtgaaaaggaacagctgaaataggaaggggaaatggactgaagaataatttgaatcgggacagtgatccatcagtcctagatgcttctggtatgtaaatatcttgaatcacattgtttcctttcttctgaaatctcaaaggagaattctcacagcactacattaaggttgccattttgttaggattcaaaatttcaatccagtagccatcaggatcttgaataaatgccaggcctttcattttaccatcatcaggtttcttcacaaatttgactccagtcttcaaccttttcaagcctgatcatcaggaacacaattccatatgaccgatc

SEQ ID NO: 574 - DNA, 202 bp, Homo sapiens
acatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgt

SEQ ID NO: 575 - DNA, 311 bp, Homo sapiens
ccacagttgtatcatatagcatctctaacatttcatctaggattatctagtatagatcttactatatttgggactatgttgtatacaatgttaacaagaacatatcttctctgcatatatgtgtgaattataaagaaaagcatgagaatgactctaagttcaacaaacatgggtgaatctctatgtgctcccagtgtcctggatgggctccccagcaagccattcctccttcctgttctgatattactattcttttttacattgtgctaaggaggacaaaagatgagagatgaaaataaagctttgccttt

SEQ ID NO: 576 - DNA, 134 bp, Homo sapiens
  misc_feature (1)...(134): n = A,T,C or G
ttttttgcatcaaaaagctttatttccatttggnccaaggcttgttaggatagttaaaaaagctgcctattggctggaggganaggcttaggcaaaanccctattactttgcaaggggcccttcaaaagtcgct

SEQ ID NO: 577 - DNA, 488 bp, Homo sapiens
ctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcattt

SEQ ID NO: 578 - DNA, 476 bp, Homo sapiens
accatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgatttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaaaaaaaa

SEQ ID NO: 579 - DNA, 246 bp, Homo sapiens
ctggtgctcactgagatggtaggttttcctattttcctgctacatctgcacaagctacatctagaatgaagccaccaatttcaatgtgaccaggcaatggcagccagcactgccttacactggtttgattctgattccctaattctggccactgcaggtgatgagtaagggtggggatcagggaggaagtccagaagccagtctttgtctccctttcctgcttatatttaagtgcctatttacatg

SEQ ID NO: 580 - DNA, 615 bp, Homo sapiens
  misc_feature (1)...(615): n = A,T,C or G
gtcttcacagtaataactaatggtggatcctaaggtgaaattatttccttcaaaatagncatgaactgnattcccaggagggncacagtccctacttttgcanatgggaaagggaggtgcccaggtgtggtcctctagacactggctccgattgctgcccttgaggatgtagtggtcattgcacataaacgtgattttgtcacttacattcacaggccctgaagaactgaactctccattcaccagcacaggatcaggacagtggcccaagcggcactcagtagtggtgttatcccactccttagaggcattgcaaaaaagggtcttctttcctaccaggtggtagcccttgatacaaacgtaagtccccagaatctgtccttccacctcctttgcgacaaatatgctattgtccactggaggaagctctggacagtgctcatctgaagcagaaactcgccacgcaaccataagacagcacgcacaccaaaaaaacatctggtgatcaaagtcctctccccaggctggaattcacccagctcagacaccttacctgtctctgtccctccagagttagggcttcccancaaggaactgggcttaactgacttccaa

SEQ ID NO: 581 - DNA, 576 bp, Homo sapiens
actcttgttgagttctgtagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttacgtgtctgaatcgagtgagacaaaattttagtccaaataacaagt

SEQ ID NO: 582 - DNA, 939 bp, Homo sapiens
atgagcatcggcctcctgtgctgtgcagccttgtctctcctgtgggcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagttactcagtcggggagggcggggattcacccctccactttgggaatgggaccaggctcactgtgacagaggacctgaacaaggtgttcccacccgaggtcgctgtgtttgagccatcagaagcagagatctcccacacccaaaaggccacactggtgtgcctggccacaggcttcttccctgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttctga

SEQ ID NO: 583 - DNA, 828 bp, Homo sapiens
atgaactattctccaggcttagtatctctgatactcttactgcttggaagaacccgtggaaattcagtgacccagatggaagggccagtgactctctcagaagaggccttcctgactataaactgcacgtacacagccacaggatacccttcccttttctggtatgtccaatatcctggagaaggtctacagctcctcctgaaagccacgaaggctgatgacaagggaagcaacaaaggttttgaagccacataccgtaaagaaaccacttctttccacttggagaaaggctcagttcaagtgtcagactcagcggtgtacttctgtgctccgaacccttctcttcagggcggatctgaaaagctggtctttggaaagggaacgaaactgacagtaaacccatatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 584 - protein, 275 aa, Homo sapiens [sequence omitted]

SEQ ID NO: 585 - protein, 312 aa, Homo sapiens
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSYSVGEGGDSPLHFGNGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 586 - protein, 97 aa, Homo sapiens
EVEVSRDHASLGDSETLSQTELRKKERKKKRERKFQANCGIDFIIFWIFWILLFSHHWIQESLLCPPSPKEVTCREMLTGGCLPWATRSHLGRRKCS

SEQ ID NO: 587 - protein, 16 aa, Homo sapiens
FQANCGIDFIIFWIFW

SEQ ID NO: 588 - DNA, 530 bp, Homo sapiens
gaattcggcacgagggctggaggctgagatgcaggagctcgccatccagctgcacaagcgctgcgaggaggtagaggccacgcggggccaggtgtgtcaggagcaggagctgcgcgccgtggtggagagctgctgctggagcaggaccgcgcccgcgaggacctccaggcccggctgcgggagacgtgggccctggcccgggatgctgccctcgtcctggaccagctgcgagcctgtcaagctgagctgtcatctcgagtgaggcaggaccagccccctggtacagccactctgggcctagccgtccccccagctgactccaagggctggcaagcgtccctgcaggccatgagcctccccgagctctcgggagccctggaggaccgtgtccgtgagatggggcaagcactgtgcttagtgacccagagcctggagaagctgcaggtgctgaacgggaagaagtggcgggagacctagcctgcgggccgaatctgacgttgggtgattggtccaccctgaagctgtgtgcc

SEQ ID NO: 589 - DNA, 349 bp, Homo sapiens
gaattcggcacgaggccagttcagtctgcaagcgccagctcctctcatggccggcttacccaccgccttgccaatgcccaggggcaaacctcataccaccacttccagaacactgatcatgacaaccaacaatcaggtacgtggtcctctggcacccttcccgctggtggtccctgggaacagcatccgagctgtgatatgcactagaggagattgatggtcctttgaattagaagagtaactttttgagtatttggccattggtgtgttgttctaggaaatcctctcttttttgtggtgttgaggtcccccatgtatagtttcagcagcgaggacactgtggttcttg

SEQ ID NO: 590 - DNA, 509 bp, Homo sapiens
gaattcggcacgaggcaatcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcgcttccagtggtgtctgtagtgagagaaacagagtcccagttactgccagatgtgggagctattgtaacctgtaaggtctctagcatcaattcacgctttgccaaagtacacatcctgtatgtggggtccatgcctcttaagaactcttttcgaggaactatccgcaaggaagatgtccgagcaactgaaaaagacaaggttgaaatttataagagtttccgcccaggtgacattgtcttggccaaagtgatctccttaggtgatgcacagtccaactacctgctaaccaccgccgagaacgagctgggagtggtggtagcccacagtgagtcaggtatccag

SEQ ID NO: 591 - DNA, 510 bp, Homo sapiens
gaattcggcacgaggtgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctcttgttccctcttcaggtaacaaccggg

SEQ ID NO: 592 - DNA, 432 bp, Homo sapiens
gacatgtaattcttatttatttttcaccctcaacaaggaagaaaggtctctccctcaattctgctcttccaatacttgaggataggcacccctaaccctccttcctccagggaggcctcagcatcagtgtctgtggacgtagtctctgaagagtgcttcagctgatggggaaggagaaactcaagacagagatcctcctagggatggcgtcactttcctgccaactttctcgttgcctctccttgaaagcagaagaagtgccagccctcagcttccgtcagatcttgggctcctagggccttgtacaagtccatggccctctggttccagtccaggacggccaggcggaattgggagcagcccttatccaaggccacctcagccacctttttgattattttggaaccaatcccttgaccccgatattccggc

SEQ ID NO: 593 - DNA, 614 bp, Homo sapiens
gaattcggcacgaggcgcagagttgtcgctactggagaagtccctgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttatagttgacctgacagttcaagaaaaggagaaatatcttaatgtatctcgctggttttgtcacattcagcattatccaggcatcaggcaacatctgtctagtgttggtcttcatcaagaacagactatatactaattcccctagaaagctgtccatgccatacagaagatctattaaaaaatgttttaaaatggaaaatgtactcttagaaccacaggacttaatggta

SEQ ID NO: 594 - DNA, 336 bp, Homo sapiens
gaattcggcacgaggggcacaacagagccgctcccctctcctcgccccgccaccgggacggagagcgcccgccggtgcatttccggcgacacctcgcagtcattcctgcggcttgcgcgcccttgtagacagccggggccttcgtgagaacggtgcaggcctggggtagtctcctgtctggacagagaagagaaaaatgcaggacactggctcaagagtgcctttgcattggtttggctttggctacccagcactggttgcttctggtgggaatatttgctattgaaaagcaagcaagcgtgccgtccctggctgcagggctgctcttttggaagt

SEQ ID NO: 595 - DNA, 487 bp, Homo sapiens
gaattcggcacgaggtgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaa

SEQ ID NO: 596 - DNA, 418 bp, Homo sapiens
gaattcggcacgaggccgtgacctgctagctgagcagcgcttcccgggccgcgtgctgccctcggacttggacctgctgttgcacatgaacaacgcgcgctacctgcgcgaggccgactttgcgcgcgtcgcgcacctgacccgctgcggggtgctcggggcgctgagggagttgcgggcgcacacggtgctggcggcctcgtgcgcgcgccaccgccgctcgctgcgcctgctggagcccttcgaggtgcgcacccgcctgctgggctgggacgaccgcgcgttctacctggaggcgcgctttgtcagcctgcgggacggtttcgtgtgcgcgctgctgcgcttccggcagcacctgctgggcacctcacccgagcgcgtcgtgcagcacctgtgccaacgcaaggtggaaccccct

SEQ ID NO: 597 - DNA, 418 bp, Homo sapiens
  misc_feature 205: n = A,T,C or G
gaattcggcacgaggctggctcccacccgtgagttggctcaacagattgaggaagagaccatcaagtttgggaaaccgctaggtatccgcactgtggctgtcattggtggcatctccagagaagaccagggcttcaggctgcgcatgggttgtgagattgtgattgctcccctgggcgtttgattgatgtgctggaaaacccgtnccttgtgcttgacccgctgtacctatgtggttctggatgaggcagataggatgattgacatgggctttgagccagatgtccagaagatcctggagcacatgccttgtcagcaaccagaagcccaaacacggatgaagcttgaggacccctgagaaaaatgcttggccaacttttgagtcgggaaaacattaagtacccgcccaaacagtcatt

SEQ ID NO: 598 - DNA, 266 bp, Homo sapiens
gaattcggcacgagggcttctcactgagtgcctacttttatgtcctgcctgtggtgagcacaaatgttgagcacatcaatccccattttgtagacgaagagacagagttgagtgacttgcccaaagacacagggccagtgaggagttgtgcaggtttgccctggcattaaaataataaacattgaaattcagtcgattcccctatggactcagttatagatctcatcagttgaaggaagagagatgccttttcctattcaaccttt

SEQ ID NO: 599 - DNA, 235 bp, Homo sapiens
gaattcggcacgagggctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatcc

SEQ ID NO: 600 - DNA, 386 bp, Homo sapiens
gaattcggcacgagggttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgcttgggcagcgtgggccccgtggacctgctggtgaacaacgcccgctgtcgccctgctgcagcccttcctggaggtcaccaaggaggcctttgacagatcctttgaggtgaacctgcgtgcggcatccagtgtcacagattgtggcaggggcttaatacccgggagtcc

SEQ ID NO: 601 - DNA, 406 bp, Homo sapiens
gaattcggcacgaggggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctagcaccccgcaaccggcaccggcgctgtccagaccgaggccatgaagcagattctcggggtgatcgacaagaaacttcggaacctggaga

SEQ ID NO: 602 - DNA, 365 bp, Homo sapiens
gaattcggcacgaggctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgcgcgccggcttctagcaccccgcaaccggcaccggcgctgtccagaccgaggccatgaagcagattctcggggtgatcgacaagaaacttcggaacctg

SEQ ID NO: 603 - DNA, 376 bp, Homo sapiens
gaattcggcacgaggctttggccactcagagcccccgggccgcggtcgtcgtacgcctgaaggcgggtcgtgccggcggccgctctagtctccgcctccgctcaggccggtcctccggggcttctcaatggtttcccggtggcctctcaatggttttcccggcggcccttgcgccgacgccaggagacttccggagcttggtgacgtcacagagcgagcttttctacccaaatacgcggcgggggaataggctcgagggcggggagcagtgacaattgctaggcggagacagtgcagggaagagagaccttataaaggatcaggactggcgggaggtatttaactgaaaggaatatctgcttcactgttgcaacca

SEQ ID NO: 604 - DNA, 385 bp, Homo sapiens
gaattcggcacgaggcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtcc

SEQ ID NO: 605 - DNA, 395 bp, Homo sapiens
  misc_feature 375: n = A,T,C or G
gaattcggcacgagggggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcaaggagcggtggcccgggcggcctcacattcggcggggccttgccggcggggacaaagaaagggcattcgcaacgaagggttttgggaaacaagtaaaatgggttcaattgtaagggaaccggattttggttttnattcaaccagggaaattgac

SEQ ID NO: 606 - DNA, 282 bp, Homo sapiens
gaattcggcacgagggcaggggtggtcctggctggcattgcctgagccggcagtgatgaagtggggagcttgcccttgacaggtgggggctggctggggccttaatgtgaaaagacagtggcaggcagctggagtagagcgagcccagcagccctaaaaggctgccttcatggccatctagccccagttcagggcagcatccatagcccacaagccagcgtgggtggggcgggggtggtcccacagctgggttccacctgaagagcctccgtgcctcggagc

SEQ ID NO: 607 - DNA, 615 bp, Homo sapiens
gaattcggcacgaggccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatcctgtggaacaaaaagaaggcgctttctctatttt

SEQ ID NO: 608 - DNA, 316 bp, Homo sapiens
gaattcggcacgaggagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaaggactcaagacctcgatcacagtctttccaagcagccctttcttcccccagtgtaccgaaggaaccaagaacagacccgagaatcttccacccggacccttagcaaac

SEQ ID NO: 609 - DNA, 393 bp, Homo sapiens
  misc_feature 267: n = A,T,C or G
gaattcggcacgagggtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagaaaaaaatgctggctgcctattttgnggggcattcattttgaaatggcttgagaaatggttggctgggtcacccagaattggccttcttgaaaaccacaagaatccctttggaagggggcttctttttggggaaaataatcttggtaaaaag

SEQ ID NO: 610 - DNA, 454 bp, Homo sapiens
gaattcggcacgaggcagcaatgcggtagatatgacgtaaacaaattataattaagctagtggatactcagagatcaaaagaactgcacattgcattctggagcatgagaaatcattttttttttcatgatgtctaactctactgaatttattcaatggagataacagaaagatgattatatatgattaaattacttccagtattagcagatgcttatttaaatacttgcttgttctttctgcaattccacatagaattaaggcaatagtttaaaagaaaatttaaaaagtaacttttctagcattttaatgtagacctgtgaattctaacacatttgcagtgtagccatcctaatgactaaccagacttgaacaaaatccaacttgcaaaaacgatgcaatataaataccaatcaccaataataggtagtctcacttttaaaaacctgtgtct

SEQ ID NO: 611 - DNA, 613 bp, Homo sapiens
gaattcggcacgaggtgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcattat

SEQ ID NO: 612 - DNA, 313 bp, Homo sapiens
gaattcggcacgaggcgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggtaagaagaaggcggaaggcggcggaggcggcggtcgccccggggctccggcggcgggggacggcaaaacagaacagaaaggcggagataaaaagaggggtgttaaaagaccaccacaagatcat

SEQ ID NO: 613 - DNA, 557 bp, Homo sapiens
gaattcggcacgaggcctggccggggagacgagttgcatgtgttggttcagctggcgatagcggcgggagcggagccggcggggcctgtgcgaccgcctgggtttgtgaaatggctgctgacatttctgaatccagcggggctgactgcaaaggagacccaaggaacagtgccaagttagatgccgattacccacttcgagtcctttattgtggagtctgttcattaccaacagagtactgtgaatatatgcctgatgttgctaaatgtagacaatggttagagaagaattttccaaatgaatttgcaaaacttactgtagaaaattcacccaaacaagaagctggaattagtgagggtcaaggaacagcaggggaagaagaggagaagaaaaaacagaagagaggtggaaggggtcaaataaaacaaaaaaagaagaccgtaccacaaaaggttactatagccaaaattcccagagcaaagaagaaatatgtgacaagagtatgtggccttgcaacttttgaaattgatcttaaagaagcacaaagattttttgct

SEQ ID NO: 614 - DNA, 627 bp, Homo sapiens
gaattcggcacgaggctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgaaaaaagaactgaacagaaacgtttaaaaacttgtacttgaactacagtattgtttgg

SEQ ID NO: 615 - DNA, 474 bp, Homo sapiens
gaattcggcacgagggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttggttta

SEQ ID NO: 616 - DNA, 576 bp, Homo sapiens
gaattcggcacgaggggaatctgtgaagctcactactggaccaaacaacgctggagctcaaagtagttcttcatgtgggacttctggccttccagtttctgcacagacagccttggcagaacaacagccaaaaagcatgaaaagcccagcttctccagagcctggtttctgtgctactctttgccctatggtagaaattccacctaaagatataatggcagaattggagtcagaggatatcttgatccctgaagaatctgtaattcaggaggaaattgcagaagaggtagagactagtatctgtgaatgccaggatgaaaatcataagacaatacctgaattttctgaggaggctgaaagtctaaccaattctcatgaagaaccccaaatagcacctcctgaagataacttggaatcctgtgttatgatgaatgatgttttagaaactttgcctcatattgaagttaagatagaagggaagtcagaatcaccccaggaagaaatgacagttgttatcgatcagttagaagtctgtgactctcttattccttccacttcatctatgactcatgtcag

SEQ ID NO: 617 - DNA, 514 bp, Homo sapiens
gaattcggcacgaggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgct

SEQ ID NO: 618 - DNA, 456 bp, Homo sapiens
gaattcggcacgagggggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggc

SEQ ID NO: 619 - DNA, 262 bp, Homo sapiens
gaattcggcacgaggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggac

SEQ ID NO: 620 - DNA, 205 bp, Homo sapiens
gaattcggcacgaggatttatgggccactgcacatgcccgctgcagccctgggatcagctggaagctgcctgtcatctcctgcccaatccccagaaaccctgattcaggtctgcaggctcctgcgggctcaccaggctgctggctccggtaccatgtaaacctaggaaggtaaaggagcaggcaacctcctcgtggcctgtgtgt

SEQ ID NO: 621 - DNA, 483 bp, Homo sapiens
gaattcggcacgaggcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggtgcaggccaagctggagaacgccgaagtgctggagctgacggtgcggcgggtccagggtgtgctgcggggccgggcgcgcgagcgcgagcagctgcaggcggaagcgagcgaacgcttcgctgccggctacatccagtgcatgcacgaggtgcacacgttcgtgtccacgtgccaggccatcgacgctaccgttctgccgagctcctgaaccatctgctcgagtccatgccgctgcgtgagggcagcaacttcaggatctgctgggggacgccctgcggggccacctaaatcccctggacggaatggctggctgcgg

SEQ ID NO: 622 - DNA, 562 bp, Homo sapiens
gaattcggcacgagggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaag

SEQ ID NO: 623 - DNA, 645 bp, Homo sapiens
gaattcggcacgaggctgagagagagcacagcctggtgggttctggggtctacggcctaggggccggggaagtttgcgccgccgcgaccagtgctgcgatcccgagccgggctccagccccgaggaccaggggtcgggcgggcctgcctacggaaccccgcgggccagcagcagtcgtctcgcgtcctcctgcttggaaaagtgtttaagcttctaaaatgtcatctatcaagcacctggtttatgcagttattcgtttcttacgggaacaaagtcagatggacacttacacctcggatgaacaagaaagtttggaagttgcaattcagtgcttggagacagtttttaagatcagcccagaagatacacacctagcagtttcacagcctttgacagaaatgtttaccagttccttctgtaagaatgacgttctgcccctttcaaactcagtgcctgaagatgtgggaaaagctgaccaattaaaagatgaaggcaataaccacatgaaagaagaaaattatgctgctgcagtggattgttacacacaggcaatagaattggatcccaataatgcagtttactattgcaacagggctgctgctcagagcaaattaggtcactacacagatgcgataaaggattgtg

SEQ ID NO: 624 - DNA, 521 bp, Homo sapiens
ctgagcgtctctgcttagccgcggtcatgagccggcacagccggctgcagaggcaggttctgagcctgtaccgcgatctgctgcgcgccgggcgtgggaagccgggcgccgaggcgcgagtgcgggcagagttccggcagcatgcgggcctgccgcggtccgacgtgctgcgcatcgagtacctgtaccgccgcgggcggcgccagctgcagctgctacgctcgggccacgccaccgccatgggcgccttcgtacgcccgcgggccccgaccggggagcctggcggcgtgggttcccagcctgacgacggcgacagtccaaggaacccccacgacagcacgggggcaccggagacccgccccgacggacggtgacaggcgaagagccgaactcgctcgatggcgtggtggagccaggaggctcgcctgactgcatggggggactggggaacccgcctaaggtgagaggtcttaagagactagcttgacgaattggggatgtcagagactcctccttggcga

SEQ ID NO: 625 - DNA, 375 bp, Homo sapiens
gaattcggcacgaggagaacatgcagtctaggaaccggcatgcgcataacctcaggatataaataatgctgaagcagagttacgttttttttgttgttgttttttttgtttttgtttttttaggtttccgtgtgtttctattgagctgctcagtgcccggcttagaagaccaggaaaaggagtcacaggtcgtatgctggaggcttgagccgcggcaccgtggcgcggctcgcctcgctgcggttggtggtggcggtggacattgcagcgcggctggagggggtccttagacaaggtgcaagacaaacagaagagggcatgtggggtcaaactcctactgcctgcctgattttctgccacaggacaaattcacca

SEQ ID NO: 626 - DNA, 628 bp, Homo sapiens
gaattcggcacgaggaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaaccaaaacttatggcacgggagtaaattctcattaaaataaatgtaattaaaaggaaaaaaaaaaaaaaaaaaactcgag

SEQ ID NO: 627 - DNA, 645 bp, Homo sapiens
gaattcggcacgaggagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctctt

SEQ ID NO: 628 - DNA, 625 bp, Homo sapiens
gaattcggcacgaggggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctcttccttgtcacaggtttaaaaacctcacagcttgtataatgtaaccatttggggtccgcttttaacttggactagt

SEQ ID NO: 629 - DNA, 545 bp, Homo sapiens
gaattcggcacgagggagcccaggaggtcaaggctacagtgagccgtgatcatgccactgcactccagcctgggtgacagagcgagaccctgtctcttaacaacaaaacccatgagcggcagccccccagtcctggatggtggtaaagaatcctcaagatcaaacccacgcagtgctgagagcttggcctgattctagggctggggctggagaaactgctagagatgatgccgatagccagtgtgatccccctgccctgatggtcaagggcagagtgcagactggaaccctcccctccccaaagattcagacctgtggggctgagtgggctcatagtgtccccaagtcctgagaggctggtgtctggcttcagcctccagcttctcaggttctgatgcagtcagctgagttccctgcctattcttgcaagcactaggaggaagggtggtgggttgctgggaacagcaccgagcgccctccccacccagattcacagagcacactccccggggggatactttaatccggaggccgtgacgcctgct

SEQ ID NO: 630 - DNA, 605 bp, Homo sapiens
gaattgggcacgaggcgggccgcagcttttcggttcacagcgggcagggaaagccgcgggaagggtactccaggcgagaggcggacgcgagtcgtcgtggcaggaaaagtgactagctccccttcgttgtcagccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccgttgtacaaccatccagcaggtcccagaacagtttttttctgggctccaattatgaaatgggggttggtgtgtgctggattggctgatatggccagacctgcagaaaaacttagcacagctcaatctgctgttttgatggctacagggtttatttggtcaagatactcacttgtaattattccaaaaaattggagtctgtttgctgttaatttctttgtgggggcagcaggagcctctcagctttttcgtatttggagatataaccaagactaaaagctaaagcacacaaataaaagagttctgatcacctgaacaatctagatgt

SEQ ID NO: 631 - DNA, 364 bp, Homo sapiens
gaattcggcacgaggcgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaaaaaaactcgag

SEQ ID NO: 632 - DNA, 545 bp, Homo sapiens
gaattccggcacgaggggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcag

SEQ ID NO: 633 - DNA, 506 bp, Homo sapiens
gaattcggcacgaggctggtcactccgccaccgtagaatcgcctaccatttggtgcaagcaaaaagcaatcagcaattggacaggaaaagaatggcattgaagcagatttccagcaacaagtgctttgggggattgcagaaagtttttgaacatgacagtgttgaactaaactgcaaaatgaaatttgctgtctacttaccaccaaaggcagaaacaggaaagtgccctgcactgtattggctctcaggtttaacttgcacagagcaaaattttatatcaaaatctggttatcatcagtctgcttcagaacatggtcttgttgtcattgctccagataccagccctcgtggctgcaatattaaaggtgaagatgagagctgggactttggcactggtgctggattttatgttgatgccactgaagatccttggaaaaccaactacagaatgtactcttatgtcacagaggagcttccccaactcataaatgccaattttccagtgg

SEQ ID NO: 634 - DNA, 485 bp, Homo sapiens
gaattcggcacgagggagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttccccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcaagagccgtgcctcactgacccccaggggcctcatcctccccatggaatgggctgtatgtcctgccccaacttggcccgcagcaggccagacccccctacccccgcccagag

SEQ ID NO: 635 - DNA, 615 bp, Homo sapiens
gaattcggcacgaggcttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactcttccgagtaaatagagaattgtccaaggcaccatatcttcggcagttattaaaccag

SEQ ID NO: 636 - DNA, 504 bp, Homo sapiens
  misc_feature 12: n = A,T,C or G
gaattcggcacnaggccaaaacctgtttgggaagcatattacagaaatgatttcaagtaccctgtattctggatgctaaaaaacaaaaacaaacaaaaaaacaaaaacaaaaaaacaaaaccagaatcaggtaaaacagctatgtgattaaaatattttaattcttcagcaattacccggttttctaaattgaatcatgcatctatttataattctaattattttgtaaaagaagacaaaattatgaatcttaagtatttgctccatctttttctctgtaatggtggagaggctgcccataattcatctccacatggagccaagtttaatgtttctagttcacattttgtacttctgtcatgcttatttcaaactccctgagtgatgggtaagaaatcaaacattgcctcagtggtatcaagagaactttggtggtggtttcttcagaatcatgaagttcttttgccagataaatattttgatattattttcctttttaatata

SEQ ID NO: 637 - DNA, 449 bp, Homo sapiens
gaattcggcacgaggtttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgccgtgctggtgccattgccccatgtgaagtcactgtgccagcccagaacactggtctcgggcccg

SEQ ID NO: 638 - DNA, 524 bp, Homo sapiens
gaattcggcacgagggttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgt

SEQ ID NO: 639 - DNA, 524 bp, Homo sapiens
gaattcggcacgagggcttctcactgagtgcctacttttatgtcctgcctgtggtgagcacaaatgttgagcacatcaatccccattttgtagacgaagagacagagttgagtgacttgcccaaagacacagggccagtgaggagttgtgcaggtttgccctggcattaaaataataaacattgaaattcagtcgattcccctatggactcagttatagatctcatcagttgaaggaagagagatgccttttcctattcagcctttttgcaatccttccatctagaggagatgtatcttataatatcctcaaaggcactctgttgctaatagcagccttgatgaggtcccatatagctcattggaagcagagctagtcttggaaactgaaaatgttggaccagagtctgcccattcctttagctctgggtccagctgtggtctggggtggaatggagtctgaccttgcctcacacagggcctgtctgttctcattgtggccatccacatcctggagctgctcat

SEQ ID NO: 640 - DNA, 524 bp, Homo sapiens
gaattcggcacgaggggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtgagacagctgatggaaaagctgagggaaaagcagttgagtcatagtctgcgggcagtcagcactgacccccctcaccatgaccatcatgatgagttttgccttatgccctgaatcctgatggtttccctaaagttattacggaaacagacccctgctttcgaatttacatgttcatgatgtgcccttgttgtaaacctttacctgtcacttgttt

SEQ ID NO: 641 - DNA, 523 bp, Homo sapiens
gaattcggcacgaggcctcgtgccgtgccccccgaggtatgcggggtcactcgctgctcgatgttccctccgaagggtcggacaaggctccggagccctgtagctgccctccctaggagccccgggtcttcactggccgaggtgcccaccccgcagcattctgggagtggtagttttcttccttcaggttcattcctggctggccagtgcccaagactggcgagactacgattcccagacgcccaagcgagtcgccggtcacgtggccgcaaggacgctgggccggtgggcgggggccggcaggtgctccgcagccgtctgtgccacccagagccggcgggccgctaggtccccggagaccctgctatggtgcgtgcgggcgccgtgggggctcatctccccgcgtccggcttggatatcttcggggacctgaagaagatgaacaagcgccagctctattaccaggttttaaacttcgccatgatcgtgtcttctgcactcatgatatggaaaggcttgatcg

SEQ ID NO: 642 - DNA, 524 bp, Homo sapiens
gaattcggcacgagggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatac

SEQ ID NO: 643 - DNA, 523 bp, Homo sapiens
gaattcggcacgaggggtaacaccagaatatttggcaaagggagaaaaaaaaagcagcgaggcttcgccttccccctctccctttttttttcctcctcttccttcctcctccagccgccgccgaatcatgtcgatgagtccaaagcacacgactccgttctcagtgtctgacatcttgagtcccctggaggaaagctacaagaaagtgggcatggagggcggcggcctcggggctccgctggcggcgtacaggcagggccaggcggcaccgccaacagcggccatgcagcagcacgccgtggggcaccacggcgccgtcaccgccgcctaccacatgacggcggcgggggtgccccagctctcgcactccgccgtggggggctactgcaacggcaacctgggcaacatgagcgagctgccgccgtaccaggacaccatgaggaacagcgcctctggccccggatggtacggcgccaacccagacccgcgcttccccgccagttctttttcttcaggatcaggc

SEQ ID NO: 644 - DNA, 525 bp, Homo sapiens
gaattcggcacgagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttcggtaatactttactttaggcatccctcctgttgctagcagccttttgacctatctgcaatgcagtgttctcagtaggaaatgttcatctgttac

SEQ ID NO: 645 - DNA, 358 bp, Homo sapiens
gaattcggcacgagggggtggtggagcgctgggcggccaggctccctggctggccggtttgggcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgc

SEQ ID NO: 646 - DNA, 420 bp, Homo sapiens
gaattcggcacgaggcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgtcctcctgctcctcatgggaagatgtctcagagccttcatgacctcccctccccaacccaatgccaaagtggacttgggagctgcacaaagtcagcaggga

SEQ ID NO: 647 - DNA, 518 bp, Homo sapiens
gaattcggcacgagggctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggcctgcaccaaaaagggtcatgtcatcttcaactaca

SEQ ID NO: 648 - DNA, 561 bp, Homo sapiens
gaattcggcacgagggtccgcttgaccgagatgctgcgggcctgtcagttatcgggtgggacccccgcccccccaaagtggctctgtgggaagtttgtcctccgtccattgcgaccatgccgcaaaaactctactttaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatgggtcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcaggtgataccctgtcggtcccagcccctgcagttcagcctgaggaatctttaaaaactgatcaccctgaaattggtgaaggaaaacccacacctgcactttcagaagaa

SEQ ID NO: 649 - DNA, 428 bp, Homo sapiens
gaattcggcacgaggctgaggtggcagatagtgagcgctggtggcggagttaaagtcaaagcaggagagtaattatgaatagcgcagcgggattctcacacctagaccgtcgcgagcgggttctcaagttaggggagagtttcgagaaacacccgcgcttgcgccttccacactgtgcgctatgacttcaaacctgcttctattgacacttcttctgaaggataccttgaggttggtgaaggtgaacaggtgaccataactctgccaaatatagaaggttcaactccaccagtaactgttttcaaaggttcaaaaaaccttacttaaaagaatgcattttgattattaaccatgatactggagaatgtcggctagaaaaactcagcagcaacatcactgtaaaaaaaacaagagttgaaggaagcagt

SEQ ID NO: 650 - DNA, 428 bp, Homo sapiens
gaattcggcacgagggaggggtcgggcgtggccggcgactgaggggtcgggctggctcttgagggcccaggccctggccgacgcgcccgccgtgagcgaggaggcccgaatccgggcgtctttggttgggttgcgggcccaggccgcgccgccggggtcgggaggcgtggcaggtggcccgacagccttctttgacctctgggaaagctgacttattcctatggctttgcttctagggctttcttaggcctctttgccggctgcctgggcagcccgcgaggtgggctggagtaactggataaaagtatagggtggaatcgggcctactaggtacccctagtagtagggaagggtggtattagaccgagagggaatgtttacaactagcgttacagtttaatatttgaaaatccaaagcggaagactgg

SEQ ID NO: 651 - DNA, 341 bp, Homo sapiens
gaattcggcacgagggccgggccgtgggtgacacgtaagttgggcaggaggtggcggggcggcagaggcaccagccgacccgtcagtgacaccgctgtgccgtccccaaaaccagccgagacagctggcccccacccttccacccattgggcaggccgcacgggggcgcggcccggagtcctggtccctttgttgggcgcgcaccccctcccttaggtggcaacaaagtcgtgcagtgggagccgccgcgatagggcggggagtggccagggcgggactccaagaactgcccgggggcagcggggccaaaaagtgggaagaaggaaaaaaggcaggaggca

SEQ ID NO: 652 - DNA, 669 bp, Homo sapiens
gaattcggcacgagggaaaatttgtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtggtctaaaggatcaacttaaacagatgtcattcatatggaagaattaaga

SEQ ID NO: 653 - DNA, 322 bp, Homo sapiens
gaattcggcacgaggcttgcttctgtggaacaatgccacagtgaccacctgccactccaagactgcccatctggatgaggaggtaaataaaggtgacatcctggtggttgcaactggtcagcctgaaatggttaaaggggagtggatcaaacctggggcaatagtcatcgactgtggaatcaattatgtcccagatgataaaaaaccaaatgggagaaaagttgtgggtgatgtggcatacgacgaggccaaagagagggcgagcttcatcactcctgttcctggcggcgtagggcccatgacagttgcaatgctcatgcag

SEQ ID NO: 654 - DNA, 332 bp, Homo sapiens
gaattcggcacgagggcgggaagcagctcttgtggatcctcagtggcggaggctcggtcacccggataggtaaaggaaaacatgcctgccacacggaagccaatgagatatgggcatacagagggacacacggaggtctgttttgatgattctgggagttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaagg

SEQ ID NO: 655 - DNA, 573 bp, Homo sapiens
gaattcggcacgaggaaataaggtgaatttgggacaaatgaaaggtgagatgaaggcaaactactgtcaagggatgatctgagcctgaacaactcagtgaatgtgaagagaaaacaagattacatgtgaatatagatgttaactggaaaagcaaggagaaaaaaagggagcacaaggaagaaaaaaaaatcaaaatttgtgagccatctcaagccatcaaaaaaacttcattctattgtaggagggaagctggaaacaatggcagagtaattttgtgttaagaattaaagtactagctccagttaggcatataaatgacaattagaagggacagaagttatggttatgtcagcagcctccagtgagctaggatataaactaagtcttttcaagctgaacaaatatatacacattcaacccatttaagtgaagagacacatttaagtccacaaaagcaaacttaactacctactatataacttactttttattgaaagtatcttgcattcatgatggatgctttctgggttttaccacatattttaatggtaaaagttaaattattctttacat

SEQ ID NO: 656 - DNA, 462 bp, Homo sapiens
gaattcggcacgaggaagaaacttggaggacaggtcgataggtgcggcaaaccaccatagtacacatatacctatgtaacaaacctccacattctgcacatgtgtcccagaacttaaagtaaaatttaaaaaaaaagaaaagaaatatccagaaagattatccagcctcaaggtttatattataatggctataaacaacaaaacataaacctattttccaaaggtttccaaatatactaccgaagaaacaaacataaaaaacgactttgatatttctaaaaagcataacttaaaatttaaaaaaaaagttaatgaaaaaacaaacactcaatggttactgccttactttaagaaaaaaacatttagttaagcacattttcccccaaagctatttaaacaccaagattcagaagtaaaccttatttagatgagtttctagtcaacgaattgacctacataatc

SEQ ID NO: 657 - DNA, 383 bp, Homo sapiens
gaattcggcacgagggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacaagccttgaggcgggcctgccctccaggtccgaggctaccccgaggagaagaaagaggaggagggcagcgcaaaccgcagaccagaggaccaggagctggagagcctgtcggccattgaggcag

SEQ ID NO: 658 - DNA, 540 bp, Homo sapiens
gaattcggcacgaggtttcgagtcagtgctgccgccgctgcccgcggctttgcagagcaggatgaatgtgatagaccacgtgcgggacatggcggccgcggggctgcactccaacgtgcggctcctcagcagcttgttacttacaatgagtaataacaaccctgagttattctccccacctcagaagtaccagcttttggtgtatcatgcagattctctctttcatgataaggaatatcggaatgctgtgagtaagtataccatggctttacagcagaagaaagcgctaagtaaaacttcaaaagtgagaccttcaactggaaattctgcatctactccacaaagtcagtgtcttccatctgaaattgaagtgaaatacaaaatggctgaatgttatacaatgctaaaacaagataaagatgccattgctatacttgatgggatcccttcaagacaaagaactcccaaaataaacatgatgctggcaaacctgtcaagaaggctggtcaggagcgcccttcagtcaccagctataaggag

SEQ ID NO: 659 - DNA, 366 bp, Homo sapiens
gaattcggcacgaggcttcaaactcacacctcccgggaggagctgtcctggcgccgggtcccgcggggaaaatggtggagccagggcaagatttactgcttgctgctttgagtgagagtggaattagtccgaatgacctctttgatattgatggtggagatgcagggcttgcaactccaatgcctaccccgtcagttcagcagcagcagcctccatctactacaacatttgtgctgaatcaaataaatcatcttccacccttgggatctacaattgtaatgactaaaacaccacctgtaacaaccaacaggcaaaaccatcactttaactaagtttatccagactactgcaagccacgccccgtca

SEQ ID NO: 660 - DNA, 514 bp, Homo sapiens
gaattcggcacgaggaggaagaaaagcactagcaacttcaaagccgacggcctgtccggcactgctgaagaacaagaagaaaattttgagtttatcattgtgtccctcactggccaaacatggcacttttgaagccacgacgtatgaggagcgggacgctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccaatcgagctcatcaaggtgatgtcatccatcgggaacgagctagccaacagcgtctgggaagagagcagccaggggcgga

SEQ ID NO: 661 - DNA, 515 bp, Homo sapiens
gaattcggcacgaggcggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggacgtggagagcagcagcagcagcagcagtcgggaggaacatgctttctgtgccaacctggggcccgtccagagcagcagcagcagcgagggcctgg

SEQ ID NO: 662 - DNA, 570 bp, Homo sapiens
gaattcggcacgaggcggctgcggcgcgccgggcggaactttccagaacgactactgagtgagaggtcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggccttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaaagaaaactggctctgcaaaagaatgtgatttgtgacaaatgt

SEQ ID NO: 663 - DNA, 307 bp, Homo sapiens
gaattcggcacgagggcgcggaggggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaa

SEQ ID NO: 664 - DNA, 496 bp, Homo sapiens
gaattcggcacgagggcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaaaaaaaaaaaaaaactcgag

SEQ ID NO: 665 - DNA, 517 bp, Homo sapiens
gaattcggcacgaggggactcgcgagagaggactcacggacctccaggacctattaacttgacagacccgcccctctattcgagccagcccaactcggagaactcagagtcatcctcgagagtaaagaaagctcttagagtttttttttttttgacaaatctatcttaaatgtcagtccaatatccacggcgacgagccacagcaggtgagaaacctggaaatgagcctgaagaggtgaagctgcagaatgccagcaaacagattgtgcagaatgcaatcctgcaagctgtgcagcaagtctcccaggagagtcagcgcagagaagagagaatcagtgacaaccgggaccacatccaactgggcgttggggagttaaccaagaagcacgaaaagaagtaacatggtggatttggctcttgacatgtgcttggtttctagccttcctcttagtataggacgcatctcccaaatgttgccagtaaagcaaacccgaagtggcacccggccctaacttgt

SEQ ID NO: 666 - DNA, 616 bp, Homo sapiens
gaattcggcacgaggggccgctcttgtccttcctcccgctttttcttctctctccttgcggtctgaagatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaaagtgcggacttgacctgaaacaagggttgaatgggagtggcaatattgtccgaagagga

SEQ ID NO: 667 - DNA, 596 bp, Homo sapiens
gaattcggcacgagggaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaatta

SEQ ID NO: 668 - DNA, 297 bp, Homo sapiens
gaattcggcacgaggggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcacta

SEQ ID NO: 669 - DNA, 458 bp, Homo sapiens
ggcacgagggatcggtcgcctgagaggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagca

SEQ ID NO: 670 - DNA, 634 bp, Homo sapiens
gaattcggcacgaggctcagctgacaaggactggggacggcggtgtccttgtcttgcctttgtcgcccccgcccctctcttccctggctggacttgcggagtccccgccgaagaacccgaggagccatatattgaagaccatgtctggaagcttctactttgtaattgttggtcaccatgataatccagtttttgaaatggagtttttgccagctgggaaggcagaatccaaagacgaccatcgtcatctgaaccagttcatagctcatgctgctctcgacctcgtagatgagaacatgtggctgtcgaacaacatgtacttgaaaactgtggacaagttcaacgagtggtttgtgtcaacatttgtcaccgcggggcatatgagggttattatgcttcatgacataagacaagaagatggaataaagaacttctttactgatggttatgatttatatataaaattttcaatgaatccattttatgaacccaattcttctattcgatcaagtgcatttgacagaaaagttcaatttcttgggaagaaacccttttaaagctgaatggagaaaattccaaataaattatatcaccaccatggtgtatactcaaaaaaaaaaaaaaaaaactcgag

SEQ ID NO: 671 - DNA, 517 bp, Homo sapiens
gaattcggcacgaggcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtcctt

SEQ ID NO: 672 - DNA, 516 bp, Homo sapiens
aattcggcacgagggtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttaaaagttcat

SEQ ID NO: 673 - DNA, 516 bp, Homo sapiens
aattcggcacgaggaacgagactgtgtctcaaaaaaatccagaagctttatcccaggtctactggacttcctagaacaccaagaaaggaaagggaattcgcctgtcatgatttagaatcatgggggaatattgtactacccaaataatgagtgacaaaaaggtacctccttgtttttaagccacaacttgaagcagttagcaaggaggtctattttggtgagaaagttggtgggttccattttcaacatgtgattcaaattacttaatacaggctgggacagggagaatgtgagcagctgatattccagctgagattaggggtccatttgtagagatggttccagaagaccaaaactatggaaagaatgacagggtcaaagtggaggagctgccggggacatccagcagtcagagaatttctgaattgaaaacatggccaagcgcagtagctcatccttgtaatccccacactttgggagaccaaagcagaaggatcccttgaggccaggagttca

SEQ ID NO: 674 - DNA, 516 bp, Homo sapiens
gaattcggcacgaggcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgcctgagagccagctacaacaacccccaccgagccgtggagtatctgctcacgggaattcctgggagccccgagccggaacacggttctgtccaggagagccaggtatcggagcagc

SEQ ID NO: 675 - DNA, 406 bp, Homo sapiens
cctcgtgccgaattcggcacgaggatcagtttaaaacagtgcctgggctcccagccctccactcacttccctgttctctgcatgggtgatactgagaggttgggaggcataggaagggggaagatcctagggagtatatgtgagcattgactatatgcagagggttttagtggtgctcgttagaaatgtttggaggcggatagaaaatatttttagaagagcatcctcccaatgttctctcctttttttctggatggaagatgtttttgtgccagaaatcagattgatacccaaagtgagatttccagtttactccacaggtcccctaattttaagggatcatcactcttgttctttttctaatcagttagtagtgctattcctgatcactgggaagtgctgttgt

SEQ ID NO: 676 - DNA, 529 bp, Homo sapiens
gaattcggcacgagggacatttcctggcattgaagaaaaatttaggcctttttatttaagtcaattagaagaaagtgtagaagaggacgtgaagagtttaaagaaagagtattcaaacgaaaaatgcagttgtgaagagaatgcagtctcttcacttgattgtgtggcagtaccttcaagccggtcaaattcagccacagaacagcctggttcacttgcacagttcccagggacttgggatgggtcctgtggaggagtcctggtttgctccttccctggagcacccacaagaagagaatgagcccagcctgcagagtaaactccaagacgaagccactaccatctttatggcagccgcatggacaggcagacgaaacagcagcccagacagaatgtggcttacaacagagaggaggaaaggagacgcagggtctcccatgacccttttgcacagcaaagaccttacgaagaattttcagaatacagagggaaaaggcctggttattccagtgcagccagtcatggtaat

SEQ ID NO: 677 - DNA, 528 bp, Homo sapiens
tggatccaaagaattcggcacgaggcctctatctcctagatgacaggatctatgcaactaacccagagatgacacagagatgaatgagatgtggctcctgtcatcaaggagctcatgattcaatggggaactaacacttagatgcatgggcagttagggacatgcaagaatctttgtaatgcaacaagagagaagttacaaggcagcacggaagtcaatgccggtgaacccagatggcctggtgagaggagcctggactagaaggaattactctcacttccaccacccgatgtatggaaactgctatactttcaatgacaagaacaactccaacctctggatgtcttccatgcctggaatcaacaacggtctgtccctgatgctgcgcgcaaagcagaatgacttcattcccctgctgtccacagtgactggggcccgggtaatggtgcacgggcaggatgaacctgcctttatggatgatggtggctttaacttgcggcctggcgtggagacctccatcagcatgag

SEQ ID NO: 678 - DNA, 528 bp, Homo sapiens
gtggatccaaagaattcggcacgaggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtg

SEQ ID NO: 679 - DNA, 309 bp, Homo sapiens
gaattcggcacgagggcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacccttcaaaaaaaaaaaaaaaaaactcgag

SEQ ID NO: 680 - DNA, 366 bp, Homo sapiens
gaattcggcacgaggcgggccgttatccatttgtgttgttcgccagctaggcctggcctcgtcccgcttcgctcggtcggtctcgcgcgcccccatagccttgctagagggttagcgttagccttaaagtgtgcgaatcccgaaggaagcaagcgacagaactcgaagaaccaccgcttcctttccttcggggaaaggaaggcgggcaccctcgcgttttgaaaggccccgcccttgccgttttggaaggccccgcccttgcgctttgcgggccccgccttgcgctttgaaggccttgtcttgccgttttgaaaatctcatttggggccgtggattgaaggaattttgggggaaggtttttggggc

SEQ ID NO: 681 - DNA, 495 bp, Homo sapiens
gaattcggcacgaggcgcggagccggccgggagaggctcggacccccaggacctccagcctttagaccctccggccctaggacccccggaacctgggacccccgagaccccagcactcgcggcggggggatggtcatggggacttctggggcttgaagaccctgggtctgcgggaagcccctgctgagcgtccctcgcctaccccgtggccagtggcttttcagtgcagaaaccaccttatctatgtgacaaagctcgggccatcagtggcaaggtagattggcatcacgtacctttgatacaacaacctgagaaggacgtcacttctgcgatattcctgccaaaaatgcatctccgcattccgatcgtgagaacatcctgggcacacccaaactgagagacaccatacaaagtgactggtcagtgcactcaaaggcaaaaagctcatggaaggcaacagaagacaggagaagtgacagctaaaagcagcgtgga

SEQ ID NO: 682 - DNA, 529 bp, Homo sapiens
gaattcggcacgagggtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacct

SEQ ID NO: 683 - DNA, 527 bp, Homo sapiens
gaattcggcacgagggaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaagttgccaaggaacacttttttgactcattctggctgcaaactacttagacatcaaaggtttgcttgatgtacatgcaagactgttgccaatatgatcaaggggaaaactcctgaggagattcgcaagaccttcaatatcaaaaatgactttctgaagaggaggaacccagtcgcaaagagaccagtgggtgaagagaagtgaatgttgtgctgcactgtacctg

SEQ ID NO: 684 - DNA, 441 bp, Homo sapiens
ctcgagttttttttttttttttttatagtacaaacttagggctctttattcaggcagtaaagtaaggaacagcaaagtgggagggctacaccatcaccatggcaacagaaagcctcaaaaacataaagtccctcgacttatgtcgggtagactcttcctagctcaggagaaacacattttaactggctgaggacaaggccaggcagcctggccacactgcggaagggcagctggacgcgcggcctctggtcagtcctggaagtgcttggtgagggcttccagcagctcctgcttcttcagcccactcttcagcccgtaagcccggcaggcctctttcagcatgggcacagtgaacttgcccagcgtacccttgctgatgtgggtcttcagctcctcttctgaatactccaccttgggccttttgcttccagaaccttcatt

SEQ ID NO: 685 - DNA, 490 bp, Homo sapiens
aagaattcggcacgaggccgagctgaagttcgaacccactatgatccccctcgaaagctcatggctatgcagcggccaggtccctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcacacagatatgtggagctcttcttaaattctctgcaggaacaagtgggggtgct

SEQ ID NO: 686 - DNA, 618 bp, Homo sapiens
gaattcggcacgaggcttttttattctgtgaatgtttttgtttttattatgaaatatattaaaattgaaaagtacagagaataatcggtgtctactgtaacaccaccagatttaacaatgttaatgttacgccatatttgtttcaaatatttttgtaatattgaacattatggatagagttaaagcttgtttgtatccatcccgttgtttacattctccatcccctacataggtaaccactattctgaagttgatgtgtattctttgtgtacatgcttttataccttttctgcatatgtatgtatccataaataatatgtagtctgttgtgtgtttttaaactttacacagtggatgtcgtactcttacatgtattctgcagcttgcatttttcacacattcattttgaatattcgttcatgttaacaatgtagatctagttttctttttaaactctgtatagtattcttatgtatgacatacacttgttgttatacatttgaattatttccaggtattcttttttgtgtgtggtatgtaaagtcacgatggcagagatttttgaaggaagataaattattttaggattacatttacagcgcaggcccacttcaaggt

SEQ ID NO: 687 - DNA, 410 bp, Homo sapiens
  misc_feature 396: n = A,T,C or G
ggggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaacactaaagaataaagtggatcatggggaaggttgcctatctctgcacctccttgggatattgcgggacttcttaagcagttttttagggactgccagagcccattctcccnctgatttgcatgaa

SEQ ID NO: 688 - DNA, 412 bp, Homo sapiens
ggccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgtt

SEQ ID NO: 689 - DNA, 412 bp, Homo sapiens
gccttgctaacgctgccgtcggggaggattgatgtcccttcagcatcatgcagcccgccgccgaggaaggtgaaagttacacaagaactgaaaaacattcaagttgagcagatgacaaaacttcaagccaaacatcaagcagaatgtgatttgcttgaagatatgaggacattcagtcagaagaaggctgctattgaaagagagtatgcacagggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgacctgcaaggacagtgagaagctt

SEQ ID NO: 690 - DNA, 412 bp, Homo sapiens
gggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtgccgttaattaaggaaaagttgagccagggcgtgaccctcgtcgtggacagatacgcattttctggtgtggccttcaccggtgccaaggagaatttttccctagactggtgtaaacagccagacgtgggccttcccaaacccgacctggtcctgttcctccagttacagctggc

SEQ ID NO: 691 - DNA, 412 bp, Homo sapiens
ggttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaaaactgagca

SEQ ID NO: 692 - DNA, 412 bp, Homo sapiens
gcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtggagcccagtgacaccatcgagaacgtcaaagcaaagatccaggacaaggaaggcattcctcctgaccagcagaggttgatctttgccggaaagcagct

SEQ ID NO: 693 - DNA, 413 bp, Homo sapiens
ggtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccaagctgcatgcccattaatctgggcttttttcttttgcgggtcaatgtgggttttaatgctgaatcaaatgtttaacttttccaagacttgggggaatctgaagttcccatctacacttctacccacttttcctgcccaacctaaaccttcgtttaagtaattggaagggactggttcccttccttttgttggaagggaaccaggaaggaaag

SEQ ID NO: 694 - DNA, 441 bp, Homo sapiens
  misc_feature 100,138,202,203,211,237,287: n = A,T,C or G
actagtggatccaaagagagagagagagagagagagagagagagagagagagagagagagagagagagagagagaggcgcccgaggcgcggaggggctgnctgggcaggaggggttggcggggcagcagggccgcggncatggggagcttgaaggaggagctgctcaaagccatctggcacgccttcaccgcactcgaccannaccacagnggcgaggtctccaagtcccagctcanggtcctttcccataacctgtgcacggtgctgaaggttcctcgtgacccanttgcccttgaagagcacttcagggatgatgatgagggtccagtgtccaaccagggctacatgccttatttaaacaggttcattttggaaaaggtccaagacaactttgacaagattgaattcaataggatgtgttgggaccctctgtgtcaaaa

SEQ ID NO: 695 - DNA, 413 bp, Homo sapiens
gctcgtctcccgcggcccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttca

SEQ ID NO: 696 - DNA, 399 bp, Homo sapiens
ggcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcc

SEQ ID NO: 697 - DNA, 398 bp, Homo sapiens
gcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtat

SEQ ID NO: 698 - DNA, 396 bp, Homo sapiens
gaactcaaaagtggaaaatatgtacaatctgtaatgagctttttcctgaaaatgtctatagtgtgcacttcgaaaaagaacataaagctgagaaagtcccagcagtagccaactacattatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatg

SEQ ID NO: 699 - DNA, 398 bp, Homo sapiens
ggccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcc

SEQ ID NO: 700 - DNA, 399 bp, Homo sapiens
gcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatct

SEQ ID NO: 701 - DNA, 399 bp, Homo sapiens
gatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttgg

SEQ ID NO: 702 - DNA, 398 bp, Homo sapiens
gccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgaga

SEQ ID NO: 703 - DNA, 403 bp, Homo sapiens
ggttacaaaagttgaagtgcagaagttctttgcagactttcttcttgctgaggatgacatttacttgctttatgatgacaaaggtgttggtctgggagaagcattagtgaaatttaaatcagaagaacaggccatgaaagctgaacgtttaaaccgacgaagattcctagggacagaggtgttattaagacttatatctgaggcacaaatacaggagtttggtgtaaatttttctgtgatgtccagtgaaaaaatgcaagctcgctcacagtcacgtgagcgaggtgaccattcccatttatttgactcaaaagacccaccaatatactcagttggtgcttttgaaaactttagacatcagctagaggacttgaggcaactggataacttcaagcatccccag

SEQ ID NO: 704 - DNA, 411 bp, Homo sapiens
cacgaggccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactatttttta

SEQ ID NO: 705 - DNA, 203 bp, Homo sapiens
gagaacgtccactgcgggccggcgaaagctggttccttgtggagaagcactggtataagcagtgggaggcatacgtgcagggaggggaccaggactccagcaccttccccggctcatctggcgccccagcctcccctgcctgcagctccccacccagctctgagttcatggatgttaattgagagccctgggtcctgccacag

SEQ ID NO: 706 - DNA, 402 bp, Homo sapiens
gtgtgggcaggcagggtaggtggcccacccagttcactcccacgctggggacctgcagagctggctgtccgagacaggttgtttggaccaacatctgggtttctggatttccatttgagcacagctggactacacaggctgaagctctctctgccgagatatagatatttccctggtgatgatctttcaagctgacatgaagacatggccacccactggaacgtcgtgtgtctgccgtggcgctcttgtaatttgtgagggaggctcctgacgaatgcagtgcgtaagtgggaaatggtgggaagttctcgcatccccccgcttggccgaaagtgctgcctgcgcagatttgtggatggtcctttgagcaggaagaagacacggaacacattcctgttagct

SEQ ID NO: 707 - DNA, 411 bp, Homo sapiens
gcacgaggcacgactgttacagaggtctccagagccttctctctcctgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgaccgccaattctaagattgtagtggtaactgcaggagtccgtcagcaagaaggggagagtcggctcaatctggtgcagagaaatgttaatgtcttcaaa

SEQ ID NO: 708 - DNA, 418 bp, Homo sapiens
ggcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgac

SEQ ID NO: 709 - DNA, 422 bp, Homo sapiens
gcggagtcggcggtggtcgtccagaccgagtgttctttactttttgtttggttgaggtttcacgctagaaggtggctcaggatgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagggcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaa

SEQ ID NO: 710 - DNA, 424 bp, Homo sapiens
gcgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctc

SEQ ID NO: 711 - DNA, 425 bp, Homo sapiens
gctcgcgccccttttcctacactttcctcttctccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatcc

SEQ ID NO: 712 - DNA, 425 bp, Homo sapiens
ggtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaag

SEQ ID NO: 713 - DNA, 423 bp, Homo sapiens
gccgacaaaatggacatgtctctggacgacatcattaaactgaaccggagccagcgaggcggccggggcgggggccggggccgcggccgggccggctcccagggcggccgcggcggtggggcgcaggccgccgcgcgagtgaatcgaggcggcgggcccatccggaaccggccggccatcgcccgcggcgcggccggcggaggcggcaggaaccgaccggcgccctacagcaggccaaaacaacttcccgacaagtggcagcacgatcttttcgacagtggcttcggcggtggtgccggcgtggagacaggtgggaaactgctggtgtccaatctggattttggagtctcagacgccgatattcaggaactctttgctgaatttggaacgctgaataaggcggctgtgcactatgatcgctct

SEQ ID NO: 714 - DNA, 425 bp, Homo sapiens
gcggcagtagaagatggtgaaagaaacaacttactacgatgttttgggggtcaaacccaatgctactcaggaagaattgaaaaaggcttataggaaactggccttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtg

SEQ ID NO: 715 - DNA, 423 bp, Homo sapiens
gatcatatagtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcac

SEQ ID NO: 716 - DNA, 424 bp, Homo sapiens
gcggcggcgcggagagacgcagcggaggttttcctggtttcggaccccagcggccggatggtgaaatcctccctgcagcggatcctcaatagccactgcttcgccagagagaaggaaggggataaacccagcgccaccatccacgccagccgcaccatgccgctcctaagcctgcacagccgcggcggcagcagcagtgagagttccagggtctccctccactgctgtagtaacccgggtccggggcctcggtggtgctcctgatgcccctcacccacccctgaagatcccaggtgggcgagggaatagtcagagggatcacaatctttcagctaacttattctactccgatgatcggctgaatgtaacagaggaactaacgtccaacgacaagacgaggattctcaacgtcagtccaggctca

SEQ ID NO: 717 - DNA, 424 bp, Homo sapiens
gggcagctagggagcgcggcttgaggagggcggggccgccccgcaggcccgccagtgtcctcagctgcctccgcgcgccaaagtcaaaccccgacacccgccggcgggccggtgagctcactagctgacccggcaggtcaggatctggcttagcggcgccgcgagctccagtgcgcgcacccgtggccgcctcccagccctctttgccggacgagctctgggccgccacaagactaaggaatggccaccccgcccaagagaagctgcccgtctttctcagccagctctgaggggacccgcatcaagaaaatctccatcgaagggaacatcgctgcagggaagtcaacatttgtgaatatccttaaacaattgtgtgaagattgggaagtggttcctgaacctgttgccagatggtgcaatgttc

SEQ ID NO: 718 - DNA, 425 bp, Homo sapiens
gtcggctcctcgcgcgctcgcgtcccctcgtgcgggctccagccgcagccttagcttcggctcccggcttgggtggcgcggccgtgccctcgttttggcctccgaacgcggctcgaatggcaagccaaaattccttccggatagaatatgatacctttggtgaactaaaggtgccaaatgataagtattatggcgcccagaccgtgagatctacgatgaactttaagattggaggtgtgacagaacgcatgccaaccccagttattaaagcttttggcatcttgaagcgagcggccgctgaagtaaaccaggattatggtcttgatccaaagattgctaatgcaataatgaaggcagcagatgaggtagctgaaggtaaattaaatgatcattttcctctcgtggtatggcagactggatcagga

SEQ ID NO: 719 - DNA, 413 bp, Homo sapiens
gccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaaacagaaa

SEQ ID NO: 720 - DNA, 414 bp, Homo sapiens
gaaagcctcttgtcatctctcagatgggttccaaaaagaagcccaaaattatccagcaaaacaaaaaagagacctcgcctcaagtgaagggagaggagatgccggcaggaaaagaccaggaggccagcaggggctctgttccttcaggttccaagatggacaggagggcgccagtacctcgcaccaaggccagtggaacagagcacaataagaaaggaaccaaggaaaggacaaatggtgatattgttccagaacgaggggacatcgagcataagaagcggaaagctaaggaggcagccccagccccacccaccgaggaagacatctggtttgacgacgtggacccagcggatatcgaagctgccataggtccagaggcggccaagatagcgaggaaacagttgggtcagagcg

SEQ ID NO: 721 - DNA, 414 bp, Homo sapiens
ggcggcgcaggccgggctgggcccgcgcgcggcggcagcggcgccccgggccggaggcggcccagccgagcgggccatggccaccgccattcagaacccgctcaagtcgcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaag

SEQ ID NO: 722 - DNA, 412 bp, Homo sapiens
  misc_feature 262,396: n = A,T,C or G
gccagcctctggtaaccatccttctactttctatgtccatgaattaaattgtcttgatttttagatcccataagtgagaacatgcagtgtttgactttctgtgccttatttgacttaacatagtgacctcccattttcatctgtgttgttgcaaatgacaggatctcattcttttttattgctgaatagtactccactgtgtatgtgtaccacatttctttatccattcatctgttgatgggacacttgagtcttcttccanatctttgcctattgtgaacaatgctgcaacaaacagtatatgagaatgcagatatcttccatatgttgattcctttcttttgggtatatacccagcagtgggattgctggatcatatggagctttatttttagntttttgaggacctcca

SEQ ID NO: 723 - DNA, 451 bp, Homo sapiens
tagtggatccaaagaaaaaggctgctgatcaaaaaaccaaagtgccagaacctactaagacctgttcaagccagccccaacctgccggtaccagtaccagtacttccaccagcactatctcaagcagcaacaatggcaaacgtgcatctgccagtggccagcagccagctgcatcccgttacctgcctcgtgaggtgcctccacgcttccgccagcaagaacagaagcagctattaaagagaggccagccattgcctacggggactctaaccagtgtgagcccaacccagggtgctgggcctgcaggggtaagcccacctcccctacctggagccggaacacagcatcatcccagtaagctccaaccagatctcagtcatagtggattggcagatcattatgaaaattcccactggggacagcagcctacttacagaagcgaagccaactg

SEQ ID NO: 724 - DNA, 425 bp, Homo sapiens
gggtgattcagccctgacttctcaaaaagcactgcacagaggaggaggcagcagaaccccacttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttaggagagaaaaatcaaagtaagttaattactgttcaagacagagaatcagaagaagagctttcttgttggcaaatctggcaaca

SEQ ID NO: 725 - DNA, 421 bp, Homo sapiens
ggacgaccgaacgcccccgggaacaccgggccccgagctcggtcccgcgcccgaggatcctgcacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaaccttctgggaagggcttgcagaagtaaagtgcccgccttcttgcgcttccgaacggaggcaacgaaggcctggtgggaagtaaggtcccttttgttcccgacagggtggcgaacactttgggcgctgcatgcttg

SEQ ID NO: 726 - DNA, 413 bp, Homo sapiens
gagatccatcccggaagtgcttactcgtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaa

SEQ ID NO: 727 - DNA, 414 bp, Homo sapiens
ggttttttgcagctggagatgctgcggatgtaactcaggatataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagggtacatcagatgcctgggttgaccagttcacaagaccagtaaacacatctgcccttgatatggagtttgaacgagccaagtcagctatagaagtctgatgtcgatttctgggacaagttgcaggcagagttgg

SEQ ID NO: 728 - DNA, 2170 bp, Homo sapiens
  misc_feature (1)...(2170): n = A,T,C or G
gctcgtctcccgcggcccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctgkctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagcaactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttt

SEQ ID NO: 729 - DNA, 4747 bp, Homo sapiens
gagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggagcagctagaggtatttcagagagagcaaactaagcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggacgctggagcagctgcagaaggaaaacaaagagctgcgagctgaagctgaacggctgggccatgagctacagcaggctgggctgaagaccaaggaggctgaacagacctgccgccaccttactgcccaggtgcgcacgctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccaggtcaggaggcagccttcctccctatgtctgtttatggagtgcctgctgtttatcaggctgtatcctagtgagataaataagatgtgatctaaatttattcttagagaagaataaagaaaaacgggtattataccagatatctatttagggcacagttggaataaaaagcaagtggtcaagaaaggcttcgtggaagctatcgctcctgctgagtcctgaaagcatccataggtgtgtgtgccaggttgacgagaagagcagtgtgaacagaggctgtgaaagagcctgactaagctgagatgtgaggccaggaaggcccattggagaccggctattaagacttgatcctaaaggcattgaggaaaccttggtggctgtaattgaaaggtttaggagaaaaaaaaaggaaccttggaagaatttgaaactgaagagtacatggttaatttgcatcttaaaaagattattctaatagctagtatagaagttaagactggaaaaatgtttttattaaacacttacatttacttattttgtgctagacataaagcactcatgacaattatacctgatttatcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtg

SEQ ID NO: 730 - DNA, 2264 bp, Homo sapiens
gtttttttcggcctggcctgggcaggcgcttgtgctgccagggcgccgggcccggggaggccggggtctcgggtggccgccggcccaggcgctggacggcagcaggatggggaaggcgaaggtccccgcctccaagcgcgccccgagcagccccgtggctaagccgggtcctgtcaagacgctcactcggaagaaaaacaagaagaaaaaaaggttttggaaaagcaaggcgcgggaagtaagcaagaagccagcaagcggccccggtgctgtggtgcgacctccaaaggcaccagaagacttttctcaaaactggaaggcgctgcaagagtggctgctgaaacaaaaatctcaggccccagaaaagcctcttgtcatctctcagatgggttccaaaaagaagcccaaaattatccagcaaaacaaaaaagagacctcgcctcaagtgaagggagaggagatgccggcaggaaaagaccaggaggccagcaggggctctgttccttcaggttccaagatggacaggagggcgccagtacctcgcaccaaggccagtggaacagagcacaataagaaaggaaccaaggaaaggacaaatggtgatattgttccagaacgaggggacatcgagcataagaagcggaaagctaaggaggcagccccagccccacccaccgaggaagacatctggtttgacgacgtggacccagcggatatcgaagctgccataggtccagaggcggccaagatagcgaggaaacagttgggtcagagcgagggcagcgtcagcctcagcctcgtgaaagagcaggccttcggcggcctgacaagagccttagccttggactgtgagatggtgggcgtgggccctaagggggaggagagcatggccgcccgtgtgtccatcgtgaaccagtatgggaagtgcgtttatgacaagtacgtcaaaccaaccgagcccgtgacggactataggacagcggtcagtgggattcggcctgagaacctcaagcagggagaagagcttgaagttgttcagaaggaagtggcagagatgctgaagggcagaattctagtggggcacgctctgcataatgacctaaaggtactatttcttgatcatccaaaaaagaagattcgggacacacagaaatataaacctttcaagagtcaagtaaagagtggaaggccgtctctgagactactttcagagaagatccttgggctccaggtccagcaggcggagcactgttcaattcaggatgcccaggcagcaatgaggctgtacgtcatggtgaagaaggagtgggagagcatggcccgagacaggcgccccctgctgactgctccagaccactgcagtgacgacgcctagcagtcctgccctgctgctgctgccgccccgctacagaggcaatgtgaccagtcacagggacagatcacatctccccagagtggcaactctggtgaaaccttttcagaatcatggcagaggggcgtggcgtggtgctactgagaaggtcctccttcctcttgactttgtggtctgaaacctggtcttactgtccatgtgtgtttgggcccggatggtcagggtggggagcagggacggccatgggcacgcctggccacgctttaccgactgctgaccccctgggccaggtgaggttggggcctgtgggccgccagtccatacggtgctgtcactgcccatcttcggtgacaccctggggtgaggtgctcagcaccttcctctcgaggagccacattttcctcctttgtgttaggggacataacaagctctgctgggcttgagggacccagaccaggtgtctgcagtcagctcctgagacacagctggccggcacaacaggtgttacatcaggggtttcctgtggccgtttgaactttgagcatttatctaaattaaattggcccagggttggctggtgggtcacccagcagaggcttctccccatagcacgaggatgtgttgcctgggcacggtgactgcggttattcctggaggtcggcagacatgccaaccttgggctatttgagctggagaagctatgtgatgctagccggtggctttctgggctaggccccagtttgaggctcccctgggaactagagccaggaacagccagtggcactgacaaggggacggagtccaaggcgttattgggccacctgacagctggacagaaaaggggcagacacaccgaggatgcgatttaaaataaatgcagatgtttacttgg

SEQ ID NO: 731 - DNA, 2990 bp, Homo sapiens
aaaaaggctgctgatcaaaaaaccaaagtgccagaacctactaagacctgttcaagccagccccaacctgccggtaccagtaccagtacttccaccagcactatctcaagcagcaacaatggcaaacgtgcatctgccagtggccagcagccagctgcatcccgttacctgcctcgtgaggtgcctccacgcttccgccagcaagaacagaagcagctattaaagagaggccagccattgcctacggggactctaaccagtgtgagcccaacccagggtgctgggcctgcaggggtaagcccacctcccctacctggagccggaacacagcatcatcccagtaagctccaaccagatctcagtcatagtggattggcagatcattatgaaaattcccactggggacagcagcctacttacagaagcgaagccaactgcagctgggataaagtgataatagataggactgacaaggaggcgtggccttccatcacaggaacagagactgaatctgcctcagaatgtactacagacactgactctgcctccaactgtggctcagagaacagtagcatggctacagggagtgcccagggcaacttcactggacataccaagaagacaaatggcaataatggcaccaatggcgcactcgtccaaagcccttctaatcagagtgcccttggagcagggggagcgaacagtaatggaagtgcggccagagtgtggggtgtagccacaggctccagctctggcctggctcactgctctgtcagtggtggggatggaaaaatggacactatgattggagatgggagaagtcagaattgctggggtgcttccaactccaatgctggcattaatcttaaccttaatcctaatgccaacccagctgcctggcctgtacttggacatgaaggaaccgtggcgacaggcaacccttccagtatttgcagtccagtcagtgccataggtcaaaatatgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctatacaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccaggtaggaaaggtatttcatgtttctttacaagt

SEQ ID NO: 732 - DNA, 2247 bp, Homo sapiens
gactcgcgagagaggactcacggacctccaggacctattaacttgacagacccgcccctctattcgagccagcccaactcggagaactcagagtcatcctcgagagtaaagaaagctcttagagtttttttttttttgacaaatctatcttaaatgtcagtccaatatccacggcgacgagccacagcaggtgagaaacctggaaatgagcctgaagaggtgaagctgcagaatgccagcaaacagattgtgcagaatgcaatcctgcaagctgtgcagcaagtctcccaggagagtcagcgcagagaagagagaatcagtgacaaccgggaccacatccaactgggcgttggggagttaaccaagaagcacgaaaagaagtaacatggtggatttggctcttgacatgtgcttggtttctagccttcctcttagtataggacgcatctccaaaatgttgccagtaaagcaaaccgaagtgtcaccggcacctagctgtagaatgaattcacactagcccctggctgagaagcactgttttgaaaaagtgcattagacgattctgttcatatttatgcagtgcctctgagacatagtggggccaaatatgacactgtaattgcaaaagtagttttgcaggccaatttacttctgccttttatgcgttccttctgtgaatttaacaagcagcctttttgctgaaatactgaatacagtactgagttctttatgatatattaaaaagacatgctagaaaggtgagggaatgcagttttagttaccttcaaatgtgaaattgaaggctttaagtgggttcaggtctaagatcaaattaagaaaagggaaattctaaggctgagtccctcgggaccataccaaggcatttactaatatttatgttattttaagaaagggaggagtttaagtttctcaagaactcagtcttttagtctcaattctctgaatgatttcataattggtgtttatgctctgtgtagaaatcttttgggaatattatggatttcttttctcaagattaaataaaataagacaagtgagtctacacatgtgagttgccaatgactcatttccttagcagcctcatggagaatggctagaagtgtagatttcttcaacagctgcctatcattaagagacttacacttggggctgattatggggtgcaacatccttggaagggattctggggtccttaacgaatgctgttttgccactaggctatgcatttgcattaggaccttactaacttttcccattcacacattaaattttttttttgagattatgaaaatcatacaggtcaggaatacatgagaacacaatggggacagtaaagtgacagtgttttgaatgcagtgacagagatatgtgtgtgtacacgtgtaataaagttatctgtgcagcaacaggatcaatccctgctccacttctgtgaggataatgcacatatttctggagtatctacagtcccatttcctgggcttcacaaaagttattgaattggtgctattggggacagaggaagaatttgaccttggttaaaaaccttctggtttcagagtatcaatatctacatttgatttttttttaaagcaaagtattcgggtataaattgtgactgatattaagatatacttctaaaattccaatatgctacagtttctagaataaatagttggataatagataatgaatgaaaaatatcttaccagctttgttatgctatctcccacagtgcacaggtggaataaattcacaggaaacatggaaggagaaggaagcagaagggcttaaaatttaaagattgtttactcacaagtatttcttttagcagaattcatgccaagtgaagagtgagtttaagtcgaccaaaagtcatataactgatgtgatataattgcatagcatacatagtgagaatgaaggtattcagggaaattattcaggagtgccacaaataaaataaataaataaatctaatgcttgtagtttgtaagtgatctggtactatgtctactcagatatctggatatgaccagcctttgtttttgctgtcaagtgacagaaacatataaacatactatttttcctctctgatgtgtctgtactaaaaaattgggaatttttggaacatcttattgacctctgtgtctaaatgttatttataaataaaacacatacagctttgaaatatcttaagcaaaaaaaaaaaaaaaaaaactcgag

SEQ ID NO: 733 - protein, 50 aa, Homo sapiens
DSRERTHGPPGPINLTDPPLYSSQPNSENSESSSRVKKALRVFFFLTNLS

SEQ ID NO: 734 - protein, 76 aa, Homo sapiens
MSVQYPRRRATAGEKPGNEPEEVKLQNASKQIVQNAILQAVQQVSQESQRREERISDNRDHIQLGVGELTKKHEKK

SEQ ID NO: 735 - protein, 74 aa, Homo sapiens
MARSVDFFNSCLSLRDLHLGLIMGCNILGRDSGVLNECCFATRLCICIRTLLTFPIHTLNFFFEIMKIIQVRNT

What is claimed:

1. An isolated polypeptide comprising the amino acid sequence set forth in SEQ ID NO: 586.

2. A fusion protein comprising at least one polypeptide according to claim 1.

3. An isolated polypeptide comprising an amino acid sequence with at least 90% identity to the amino acid sequence set forth in SEQ ID NO: 586 wherein the polypeptide stimulates T cells specific for a polypeptide having the amino acid sequence of SEQ ID NO:586.

4. An isolated polypeptide comprising at least 10 contiguous residues of the amino acid sequence set forth in SEQ ID NO:586, wherein the polypeptide stimulates T cells specific for a polypeptide having the amino acid sequence of SEQ ID NO:586.

5. The polypeptide of claim 4, wherein the polypeptide comprises the amino acid sequence set forth in SEQ ID NO:587.

6. The polypeptide of claim 4, wherein the polypeptide comprises amino acid residues 35–50 of SEQ ID NO:586.

7. An isolated polypeptide comprising an amino acid sequence with at least 90% identity to the amino acid sequence set forth in SEQ ID NO:587, wherein the polypeptide stimulates T cells specific for a polypeptide having the amino acid sequence of SEQ ID NO:586.

8. An isolated polypeptide comprising at least 10 contiguous residues of the amino acid sequence set forth in SEQ ID NO:587, wherein the polypeptide stimulates T cells specific for a polypeptide having the amino acid sequence of SEQ ID NO:586.

* * * * *